US011965015B2

(12) United States Patent
Dower et al.

(10) Patent No.: US 11,965,015 B2
(45) Date of Patent: *Apr. 23, 2024

(54) IL-7R-α-γ BINDING COMPOUNDS

(71) Applicant: MEDIKINE, INC., Menlo Park, CA (US)

(72) Inventors: William J. Dower, Menlo Park, CA (US); Michael C. Needels, Menlo Park, CA (US); Ronald W. Barrett, Menlo Park, CA (US); Alice V. Bakker, Menlo Park, CA (US); Steven E. Cwirla, Menlo Park, CA (US)

(73) Assignee: Medikine, Inc., Menlo Park, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/350,543

(22) Filed: Jul. 11, 2023

(65) Prior Publication Data
US 2023/0357358 A1 Nov. 9, 2023

Related U.S. Application Data

(63) Continuation of application No. 17/166,462, filed on Feb. 3, 2021, now Pat. No. 11,746,139.

(60) Provisional application No. 63/041,158, filed on Jun. 19, 2020, provisional application No. 62/969,432, filed on Feb. 3, 2020.

(51) Int. Cl.
C07K 14/715 (2006.01)
A61K 38/00 (2006.01)

(52) U.S. Cl.
CPC .......... C07K 14/7155 (2013.01); A61K 38/00 (2013.01); C07K 2319/00 (2013.01); C07K 2319/30 (2013.01)

(58) Field of Classification Search
None
See application file for complete search history.

(56) References Cited

U.S. PATENT DOCUMENTS

| | | | |
|---|---|---|---|
| 5,635,597 A | 6/1997 | Barrett et al. | |
| 9,861,705 B2 | 1/2018 | Bossard et al. | |
| 10,035,836 B1 | 7/2018 | Greve | |
| 10,689,417 B2 | 6/2020 | Dower et al. | |
| 10,703,776 B2 | 7/2020 | Dower et al. | |
| 11,248,030 B2 * | 2/2022 | Dower | C07K 14/5418 |
| 11,254,729 B2 | 2/2022 | Dower et al. | |
| 11,746,139 B2 * | 9/2023 | Dower | C07K 14/7155 |
| | | | 424/85.2 |
| 2003/0166163 A1 | 9/2003 | Gillies | |
| 2005/0054054 A1 | 3/2005 | Foss et al. | |
| 2006/0141581 A1 | 6/2006 | Gillies et al. | |
| 2009/0104218 A1 | 4/2009 | Tettelin et al. | |
| 2011/0243887 A1 | 10/2011 | Lauder et al. | |
| 2013/0330296 A1 | 12/2013 | Khaled | |
| 2017/0327555 A1 | 11/2017 | Greve | |
| 2018/0125941 A1 | 5/2018 | Greve | |
| 2018/0162919 A1 | 6/2018 | Greve et al. | |
| 2018/0362655 A1 | 12/2018 | Wang et al. | |
| 2019/0119346 A1 | 4/2019 | Garcia et al. | |
| 2019/0153058 A1 | 5/2019 | Greve | |
| 2019/0194255 A1 | 6/2019 | Tagaya et al. | |
| 2019/0202881 A1 | 7/2019 | Greve | |
| 2019/0202882 A1 | 7/2019 | Greve | |
| 2020/0040034 A1 | 2/2020 | Dower et al. | |
| 2020/0040036 A1 | 2/2020 | Dower et al. | |
| 2020/0291066 A1 | 9/2020 | Dower et al. | |
| 2020/0291067 A1 | 9/2020 | Dower et al. | |
| 2021/0130424 A1 | 5/2021 | Dower et al. | |
| 2021/0198336 A1 | 7/2021 | Dower et al. | |
| 2021/0253669 A1 | 8/2021 | Dower et al. | |
| 2021/0253670 A1 | 8/2021 | Dower et al. | |
| 2022/0119465 A1 | 4/2022 | Dower et al. | |
| 2022/0119492 A1 | 4/2022 | Dower et al. | |
| 2022/0119493 A1 | 4/2022 | Dower et al. | |
| 2023/0322880 A1 | 10/2023 | Dower et al. | |

FOREIGN PATENT DOCUMENTS

| | | |
|---|---|---|
| JP | 2017528444 | 9/2017 |
| TW | 201713699 | 4/2017 |
| TW | 201833137 | 9/2018 |
| WO | 2010/099084 | 9/2010 |
| WO | 2017/068421 | 4/2017 |
| WO | 2017/136818 | 8/2017 |
| WO | 2020/033312 | 2/2020 |
| WO | 2020/247388 | 12/2020 |
| WO | 2021/092075 | 5/2021 |
| WO | 2021/092081 | 5/2021 |
| WO | WO-2021122866 A1 | 6/2021 |
| WO | 2021/158619 A1 | 8/2021 |

(Continued)

OTHER PUBLICATIONS

International Preliminary Report on Patentability for Application No. PCT/US2020/035747, dated Dec. 7, 2021, 11 pages.
International Preliminary Report on Patentability for Application No. PCT/US2020/058963, dated May 10, 2022, 7 pages.
International Preliminary Report on Patentability for Application No. PCT/US2019/045109, dated Feb. 9, 2021, 10 pages.
International Preliminary Report on Patentability for Application No. PCT/US2021/016356, dated Jul. 28, 2022, 7 pages.
International Preliminary Report on Patentability for Application No. PCT/US2021/016361, dated Jul. 28, 2022, 6 pages.

(Continued)

Primary Examiner — Sudhakar Katakam
Assistant Examiner — Zachary J Miknis
(74) Attorney, Agent, or Firm — COOLEY LLP

(57) ABSTRACT

IL-7Rαγc binding compounds and pharmaceutical compositions comprising the IL-7Rαγc binding compounds are disclosed. IL-7Rαγc bonding compounds can act as IL-7R agonists and are useful in treating cancer, viral diseases, autoimmune diseases, and inflammatory diseases.

28 Claims, 22 Drawing Sheets
Specification includes a Sequence Listing.

(56) References Cited

FOREIGN PATENT DOCUMENTS

| WO | WO-2021158623 A1 | 8/2021 |
|---|---|---|
| WO | 2022/098890 A1 | 5/2022 |
| WO | WO-2023196876 A1 | 10/2023 |

OTHER PUBLICATIONS

International Preliminary Report on Patentability for Application No. PCT/US2020/058969, dated May 10, 2022, 8 pages.
International Preliminary Report on Patentability for Application No. PCT/US2021/058085, dated May 8, 2023, 8 pages.
Partial International Search for PCT Application No. PCT/US2019/045109, dated Nov. 5, 2019, 17 pages.
International Search Report and Written Opinion for PCT Application No. PCT/US2019/045109, dated Jan. 14, 2020, 20 pages.
Partial Search for Application No. PCT/US2020/035747, dated Oct. 5, 2020, 18 pages.
International Search Report and Written Opinion for Application No. PCT/US2020/035747, dated Dec. 1, 2020, 22 pages.
International Search Report and Written Opinion for PCT Application No. PCT/US2020/058963, dated Apr. 7, 2021, 12 pages.
International Search Report and Written Opinion for PCT Application No. PCT/US2021/016356, dated Jul. 13, 2021, 12 pages.
International Search Report and Written Opinion for PCT Application No. PCT/US2021/016361, dated Jul. 15, 2021, 12 pages.
International Search Report and written Opinion for PCT Application No. PCT/US2020/058969, dated Apr. 6, 2021, 14 pages.
International Search Report and Written Opinion for PCT Application No. PCT/US2021/058085, dated Jun. 2, 2022, 14 pages.
Betts et al., "Chapter 14: Amino Acid Properties and Consequences of Substitutions, Bioinformatics for Geneticists", 2003, Barnes and Gray Eds., 28 pages.
Burtea et al., "Screening for peptides targeted to IL-7Ra for molecular imaging of rheumatoid arthritis synovium", Arthritis Res Therapy, Oct. 2016, vol. 18, No. 1, 230, 19 pages.
Chen et al., "Fusion Protein Linkers: Property, Design and Functionality", Advanced Drug Delivery Reviews, Oct. 2013, vol. 65, No. 10, pp. 1357-1369.
Dower et al., "MDK/MDK-701: A potent fully efficacious peptidyl agonist of IL-7Rαγc, designed with no reference to cytokine or receptor structure and unrelated to IL-7, fused to an FC-domain for PK enhancement", Journal for ImmunoTherapy of Cancer, 2020, vol. 8, Issue 3, pp. A341-A342.
Gronwall et al., "Generation of Affibody ligands binding interleukin-2 receptor α/CD25", Biotechnology and Applied Biochemistry, 2008, vol. 50, p. 97-112.
Klein et al., "Cergutuzumab amunaleukin (CEA-IL2v), a CEA-targeted IL-2 variant-based immunocytokine for combination cancer immunotherapy: Overcoming limitations of aldeslukin and conventional IL-2-based immunocytokines," OncoImmunology, 2017, vol. 6, No. 3, e1277306, 15 pages.
Levin et al., "Exploiting a natural conformational switch to engineer an interleukin-2 'superkine'," Nature, Apr. 2012, vol. 484, p. 529-533.
Malek, T., "The Biology of Interleukin-2", Annual Review of Immunology, Annual Reviews Inc., 2008, vol. 26, p. 453-479.
McElroy et al., "Structural reorganization of the interleukin-7 signaling complex", PNAS, 2012, vol. 109, No. 7, pp. 2503-2508.
Mitra et al., "Interleukin-2 Activity can be Fine-Tuned with Engineered Receptor Signaling Clamps," Immunity, May 2015, vol. 42, No. 5, 29 pages.
Moors et al., "Interneukin-7 (IL-7) and IL-7 splice variants affect differentiation of human neural progenitor cells", Genes and Immunity, 2010, vol. 11, pp. 11-20.
Pulliam et al., "Common gamma chain cytokines in combinatorial immune strategies against cancer," Immunology Letters, 2016, vol. 169, p. 61-72.
Rodriguez et al., "Hypothetical protein EBU92_10635 [Betaproteobacteria bacterium]", Genbank online entry, National Center for Biotechnology Information, 2 pages, retrieved from URL https://www.ncbi.nlm.nih.gov/protein/NBO41957.1, retrieved on Jan. 12, 2020.
Silva et al., "De novo design of potent and selective mimics of IL-2 and IL-15", Nature, Jan. 2019, 565(7738), pp. 186-191.
UNIPROT Database, Accession No. A0A3P7JJB2, Feb. 13, 2019, 1 page.
UNIPROTKB Accession No. A0A227JM75, Oct. 25, 2017, retrieved from URL https://www.uniprot.org/uniprot/A0A227JM75, entire document retrieved on Mar. 22, 2021, 5 pages.
UNIPROTKB Accession No. A0A444GHQ1, May 8, 2019, retrieved from https://www.uniprot.org/uniprot/A0A444GHQ1, entire document retrieved on Jun. 12, 2021, 3 pages.
UNIPROTKB Accession No. A0A0N1IMW7, Dec. 9, 2015, retrieved from URL https://www.uniprot.org/uniprot/A0A0N1IMW7, entire document retrieved on Jun. 12, 2021, 3 pages.
UNIPROTKB Accession No. A0A2D7IYS8, Apr. 25, 2018, retrieved from URL https://www.uniprot.org/uniprot/A0A2D7IYS8, entire document retrieved on Mar. 19, 2021, 3 pages.
UNIPROTKB Accession No. A0A1D1ZF92, Nov. 30, 2016, retrieved from URL https://www.uniprot.org/uniprot/A0A1D1ZF92, retrieved on Mar. 19, 2021, 3 pages.
Cooper M, et al., "A Long-Acting Pharmacological Grade Interleukin-7 Molecule Logarithmically Accelerates CART Proliferation, Differentiation, and Tumor Killing", Biol Blood Marrow Transplant, 25(3 Suppl), 223, 2019, pp. S163-S164.
Kim, Ji-Hae et al., "Hybrid Fc-fused interleukin-7 induces an inflamed tumor microenvironment and improves the efficacy of cancer immunotherapy," Clin Transl Immunology. (2020); 9(9):e1168, 16 pages.
McElroy C A et al., "Structural and Biophysical Studies of the Human IL-7/IL-7Ralpha Complex", Structure, 17(1), 2009, pp. 54-65.
NCBI Reference Sequence: NP_000197.1, "cytokine receptor common subunit gamma precursor [*Homo sapiens*]," Nov. 27, 2023 [retrieved online Dec. 9, 2023] https://www.ncbi.nlm.nih.gov/protein/NP_000197.1/, 4 pages.
NCBI Reference Sequence: NP_002176.2: interleukin-7 receptor subunit alpha isoform 1 precursor [Homo sapiens], Dec. 25, 2023; [retrieved online Dec. 26, 2023] URL: https://www.ncbi.nlm.nih.gov/protein/NP_002176.2/, 4 pages.
NCBI Reference Sequence: XP_005593949.1: cytokine receptor common subunit gamma [Macaca fascicularis], Dec. 8, 2021; ; [retrieved online Dec. 26, 2023] URL: https://www.ncbi.nlm.nih.gov/protein/XP_005593949, 2 pages.
Park, Angie I., et al.; "Abstract 2066: In vitro and in vivo properties of MDK703: An Fc-peptide fusion IL-7Rαγc agonist unrelated in structure to IL-7," Cancer Res (2022) 82 (12_Supplement):2066, 1 page.
UniProtKB/Swiss-Prot: P16871.3, Interleukin-7 receptor subunit alpha, Nov. 3, 2023, [retrieved online Dec. 27, 2023] URL: https://www.ncbi.nlm.nih.gov/protein/P16871, 8 pages.

* cited by examiner

| IL-7Rα /Rγc Ligand No. | Orient-ation P1/P2 | IL-7Rα Ligand | | | Linker Struct-ure | Rγc Ligand | | |
|---|---|---|---|---|---|---|---|---|
| | | ¹N-terminus | Amino Acid Sequence | ¹C-terminus | | ¹N-terminus | Amino Acid Sequence | ¹C-terminus |
| A | C-N | acetyl | -VHRIPWCTLDPGGLQCAWLRQMGG-- SEQ ID. NO: 407 | N/A | --GGS-- | N/A | --GGVCQDWEGVELCWQGG SEQ ID. NO: 1031 | --COOH |
| B | C-N | H₂N- | VHRIPWCTLDPGGLQCAWLRQMGG-- SEQ ID. NO: 407 | (AL2) | (L11) | (AZ4) | --GGVCQDWEGVELCWQGG SEQ ID. NO: 1031 | --C(O)--NH₂ |
| C | C-N | H₂N- | GGHLGVPWCTLDPGSIQCAWLAKHGG SEQ ID. NO: 486 | (AL2) | (L11) | (AZ4) | --GGVCQDWEGVELCWQGG SEQ ID. NO: 1031 | --C(O)--NH₂ |
| D | C-C | H₂N- | GGHLGVPWCTLDPGSIQCAWLAKHGG SEQ ID. NO: 486 | (AL2) | (L10) | --NH₂ | GGVCQDWEGVELCWQGG-- SEQ ID. NO: 1031 | (AZ5) |
| E | N-N | (AL4) | --GGHLGVPWCTLDPGSIQCAWLAKHGG SEQ ID. NO: 486 | --C(O)--NH₂ | (L8) | (AZ4) | --GGVCQDWEGVELCWQGG SEQ ID. NO: 1031 | --C(O)--NH₂ |
| F | N-C | (AL4) | --GGHLGVPWCTLDPGSIQCAWLAKHGG SEQ ID. NO: 486 | --C(O)--NH₂ | (L9) | --NH₂ | GGVCQDWEGVELCWQGG-- SEQ ID. NO: 1031 | (AZ5) |
| G | C-C | H₂N- | QCVHWDLDTLFGCIREQLELGG-- SEQ ID. NO: 483 | (AL2) | (L10) | --NH₂ | GGVCQDWEGVELCWQGG-- SEQ ID. NO: 1031 | (AZ5) |

FIG. 13A

| Ligand No. | Orientation P1/P2 | IL-7Rα Ligand N-terminus | IL-7Rα Ligand Amino Acid Sequence | IL-7Rα Ligand C-terminus | Linker Structure | Rγc Ligand N-terminus | Rγc Ligand Amino Acid Sequence | Rγc Ligand C-terminus |
|---|---|---|---|---|---|---|---|---|
| H | C/N | H2N– | –QCVHWDLDTLFGCIREQLEL–GG– SEQ ID NO: 483 | (AL2) | L11 | (AZ4) | –GG–VVCQDWEGVELCWQ–GG– SEQ ID NO: 1031 | –C(O)–NH2 |
| I | C/C | H2N– | –QCVHWDLDTLFGCIREQLEL–GG– SEQ ID NO: 485 | (AL2) | L10 | H2N– | –GG–VVCQDWEGVELCWQ–GG– SEQ ID NO: 1031 | (AZ4) |
| J | N/N | (AL4) | –GG–QCVHWDLDTLFGCIREQLEL–GG– SEQ ID NO: 485 | –C(O)–NH2 | L8 | (AZ4) | –GG–VVCQDWEGVELCWQ–GG– SEQ ID NO: 1031 | –C(O)–NH2 |
| K | N/C | (AL4) | –GG–QCVHWDLDTLFGCIREQLEL–GG– SEQ ID NO: 483 | –C(O)–NH2 | L9 | H2N– | –GG–VVCQDWEGVELCWQ–GG– SEQ ID NO: 1031 | (AZ4) |
| L | C/N | CH3–C(O)– | –IPWCTLDPGGLQCAWLRQM–GG– SEQ ID NO: 439 | (AL2) | L11 | (AZ4) | –GG–VVCQDWEGVELCWQ– SEQ ID NO: 1030 | –C(O)–NH2 |
| M | C/N | CH3–C(O)– | –IPWCTLDPGGLQCAWLR–GG– SEQ ID NO: 441 | (AL2) | L11 | (AZ4) | –GG–VVCQDWEGVELCWQ– SEQ ID NO: 1030 | –C(O)–NH2 |
| N | C/N | CH3–C(O)– | –IPWCTLDPGGLQCAWLR– SEQ ID NO: 436 | (AL2) | L11 | (AZ4) | –GG–VVCQDWEGVELCWQ– SEQ ID NO: 1030 | –C(O)–NH2 |
| O | C/N | CH3–C(O)– | –IPWCTLDPGGLQCAWLR– SEQ ID NO: 436 | (AL2) | L11 | (AZ4) | –VVCQDWEGVELCWQ– SEQ ID NO: 965 | –C(O)–NH2 |

FIG. 13B

SEQ ID NO: 1211: hIgG2
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGART (FP1) SEQ ID NO: 1212: hIgG2-Fc IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGSGSGSGSGSGSGSGSGSGSGGVH
RIPWCTLDPGGLQCAWLRQMGGGGSGGVVCQDWEGVELCWQGG (FP2) SEQ ID NO: 1213 hIgG1v-Fc IL-7Rαγc ligand fusion protein
AEPKSSDKTHTCPPCPAPEAAGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALGAPIEKTISKAKGQ
PREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGARTGGGGSGGGGSGGVHRIPWCTL
DPGGLQCAWLRQMGGGGSGGVVCQDWEGVELCWQGG (FP3) (SEQ ID NO: 1214 hIgG4-Fc IL-7Rαγc ligand fusion protein
APPCPPCPAPEFEGGPSVFLFPPKPKDTLMISRTPEVTCVVVDVSQEDPEVQFNWYVDGVEVHNA
KTKPREEQFNSTYRVVSVLTVLHQDWLNGKEYKCKVSNKGLGSSIEKTISKAKGQPREPQVYTL
PPSQEEMTKNQVSLTCLVKGFYPSDIAVEWESNGQPENNYKTTPPVLDSDGSFFLYSRLTVDKSR
WQEGNVFSCSVMHEALHNHYTQKSLSLSLGARTGGGGSGGGGSGGVHRIPWCTLDPGGLQCA
WLRQMGGGGSGGVVCQDWEGVELCWQGG (FP4) SEQ ID NO: 1215 1169_hIgG1-Fc (N-terminal fusion) IL-7Rαγc ligand fusion protein
GGVHRIPWCTLDPGGLQCAWLRQMGGGGSGGVVCQDWEGVELCWQGGGGSGGGGSGGGGS
RSDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQ
VYTLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK (FP5) SEQ ID NO: 1216 hIgG1-Fc-Knob IL-7Rαγc ligand fusion protein
GITVAEPKSCDKTHTCPPCPAPEAAGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALPAPIEKTISKA
KGQPREPQVYTLPPSREEMTKNQVSLWCLVKGFYPSDIAVEWESNGQPENNYKTTPPVLDSDGS
FFLYSKLTVDKSRWQQGNVFSCSVMHEALHNHYTQKSLSLSPGGGGGSGGGGSGGGGSGGVHR
IPWCTLDPGGLQCAWLRQMGGGGSGGVVCQDWEGVELCWQGG (FP6) SEQ ID NO: 1217 hIgG1-Fc-Hole
EPKSCDKTHTCPPCPAPEAAGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPAPIEKTISKAKGQP

FIG. 14A

REPQVYTLPPSREEMTKNQVSLSCAVKGFYPSDIAVEWESNGQPENNYKTTPPVLDSDGSFFLVS
KLTVDKSRWQQGNVFSCSVMHEALHNHYTQKSLSLSPG

SEQ ID NO: 1218 Pembrolizumab-LC
EIVLTQSPATLSLSPGERATLSCRASKGVSTSGYSYLHWYQQKPGQAPRLLIYLASYLESGVPARF
SGSGSGTDFTLTISSLEPEDFAVYYCQHSRDLPLTFGGGTKVEIKRTVAAPSVFIFPPSDEQLKSGT
ASVVCLLNNFYPREAKVQWKVDNALQSGNSQESVTEQDSKDSTYSLSSTLTLSKADYEKHKVY
ACEVTHQGLSSPVTKSFNRGEC (FP8) SEQ ID NO: 1219 Pembrolizumab-HC- IL-7Rαγc ligand fusion protein
QVQLVQSGVEVKKPGASVKVSCKASGYTFTNYYMYWVRQAPGQGLEWMGGINPSNGGTNFNE
KFKNRVTLTTDSSTTTAYMELKSLQFDDTAVYYCARRDYRFDMGFDYWGQGTTVTVSSASTKG
PSVFPLAPCSRSTSESTAALGCLVKDYFPEPVTVSWNSGALTSGVHTFPAVLQSSGLYSLSSVVTV
PSSSLGTKTYTCNVDHKPSNTKVDKRVESKYGPPCPPCPAPEFLGGPSVFLFPPKPKDTLMISRTP
EVTCVVVDVSQEDPEVQFNWYVDGVEVHNAKTKPREEQFNSTYRVVSVLTVLHQDWLNGKEY
KCKVSNKGLPSSIEKTISKAKGQPREPQVYTLPPSQEEMTKNQVSLTCLVKGFYPSDIAVEWESN
GQPENNYKTTPPVLDSDGSFFLYSRLTVDKSRWQEGNVFSCSVMHEALHNHYTQKSLSLSLGAG
SGSGSGSGSGSGSGSGSGSGGVHRIPWCTLDPGGLQCAWLRQMGGGSGGVVCQDWEGVELC
WQGG (FP13) SEQ ID NO: 1224 hIgG1-Fc (GS)10 (N297A mutant) IL-7Rαγc ligand fusion protein
DKTHTCPPCPAPELLGGPSVFLFPPKPKDTLMISRTPEVTCVVVDVSHEDPEVKFNWYVDGVEVH
NAKTKPREEQYASTYRVVSVLTVLHQDWLNGKEYKCKVSNKALPAPIEKTISKAKGQPREPQVY
TLPPSRDELTKNQVSLTCLVKGFYPSDIAVEWESNGQPENNYKTTPPVLDSDGSFFLYSKLTVDK
SRWQQGNVFSCSVMHEALHNHYTQKSLSLSPGAGSGSGSGSGSGSGSGSGSGSGGVHRIPWCTL
DPGGLQCAWLRQMGGGSGGVVCQDWEGVELCWQGG (FP14) SEQ ID NO: 1225 hIgG2-Fc (GS)10 IL-7Rαγc ligand fusion protein
ERKSSVECPPCPAPPVAGPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTKGQPREPQV
YTLPPSREEMTKNQVSLTCLVKGFYPSDISVEWESNGQPENNYKTTPPMLDSDGSFFLYSKLTVD
KSRWQQGNVFSCSVMHEALHNHYTQKSLSLSPGAGSGSGSGSGSGSGSGSGSGSGGVHRIPWCT
LDPGGLQCAWLRQMGGGSGGVVCQDWEGVELCWQGG (FP15) SEQ ID NO: 1226 hIgG2-Fc (PA)10 IL-7Rαγc ligand fusion protein
ERKSSVECPPCPAPPVAGPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTKGQPREPQV
YTLPPSREEMTKNQVSLTCLVKGFYPSDISVEWESNGQPENNYKTTPPMLDSDGSFFLYSKLTVD
KSRWQQGNVFSCSVMHEALHNHYTQKSLSLSPGAPAPAPAPAPAPAPAPAPAPAGGVHRIPWCT
LDPGGLQCAWLRQMGGGSGGVVCQDWEGVELCWQGG (FP16) SEQ ID NO: 1227 hIgG2-Fc (GGGGS)1 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE

FIG. 14B

PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGVHRIPWCTLDPGGLQCA
WLRQMGGGGSGGVVCQDWEGVELCWQGG (FP17) SEQ ID NO: 1228 hIgG2-Fc (GGGGS)3 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGSGGVHRIPW
CTLDPGGLQCAWLRQMGGGGSGGVVCQDWEGVELCWQGG (FP18) SEQ ID NO: 1229 hIgG2-Fc (GGGGS)4 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGSGGGGSGGV
HRIPWCTLDPGGLQCAWLRQMGGGGSGGVVCQDWEGVELCWQGG (FP19) SEQ ID NO: 1230 hIgG2-Fc (G)2 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGVHRIPWCTLDPGGLQCAWL
RQMGGGGSGGVVCQDWEGVELCWQGG (FP20) SEQ ID NO: 1231 hIgG2-Fc (G)5 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGGGGVHRIPWCTLDPGGLQC
AWLRQMGGGGSGGVVCQDWEGVELCWQGG (FP21) SEQ ID NO: 1232 hIgG2-Fc (GS)10 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGSGSGSGSGSGSGSGSGSGGVH
RIPWCTLDPGGLQCAWLRQMGGGGSGGVVCQDWEGVELCWQGG (FP22) SEQ ID NO: 1233 hIgG2-Fc (PA)5 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTPAPAPAPAPAGGVHRIPWCTLDPG
GLQCAWLRQMGGGGSGGVVCQDWEGVELCWQGG

FIG. 14C (FP23) SEQ ID NO: 1234 hIgG2-Fc (PA)10 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTPAPAPAPAPAPAPAPAPAPAPAGGVH
RIPWCTLDPGGLQCAWLRQMGGGGSGGVVCQDWEGVELCWQGG (FP24) SEQ ID NO: 1235 hIgG2-Fc (PA)7 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTPAPAPAPAPAPAPAPAGGVHRIPWCTL
DPGGLQCAWLRQMGGGGSGGVVCQDWEGVELCWQGG (FP41) SEQ ID NO: 1252 HSA IL-7Rαγc ligand fusion protein
GGHHHHHHGGDAHKSEVAHRFKDLGEENFKALVLIAFAQYLQQCPFEDHVKLVNEVTEFAKTC
VADESAENCDKSLHTLFGDKLCTVATLRETYGEMADCCAKQEPERNECFLQHKDDNPNLPRLV
RPEVDVMCTAFHDNEETFLKKYLYEIARRHPYFYAPELLFFAKRYKAAFTECCQAADKAACLLP
KLDELRDEGKASSAKQRLKCASLQKFGERAFKAWAVARLSQRFPKAEFAEVSKLVTDLTKVHT
ECCHGDLLECADDRADLAKYICENQDSISSKLKECCEKPLLEKSHCIAEVENDEMPADLPSLAAD
FVESKDVCKNYAEAKDVFLGMFLYEYARRHPDYSVVLLLRLAKTYETTLEKCCAAADPHECYA
KVFDEFKPLVEEPQNLIKQNCELFEQLGEYKFQNALLVRYTKKVPQVSTPTLVEVSRNLGKVGS
KCCKHPEAKRMPCAEDYLSVVLNQLCVLHEKTPVSDRVTKCCTESLVNRRPCFSALEVDETYVP
KEFNAETFTFHADICTLSEKERQIKKQTALVELVKHKPKATKEQLKAVMDDFAAFVEKCCKADD
KETCFAEEGKKLVAASQAALGLRTGGGGSGGGGSGGVHRIPWCTLDPGGLQCAWLRQMGGGG
SGGVVCQDWEGVELCWQGG

FIG. 14D

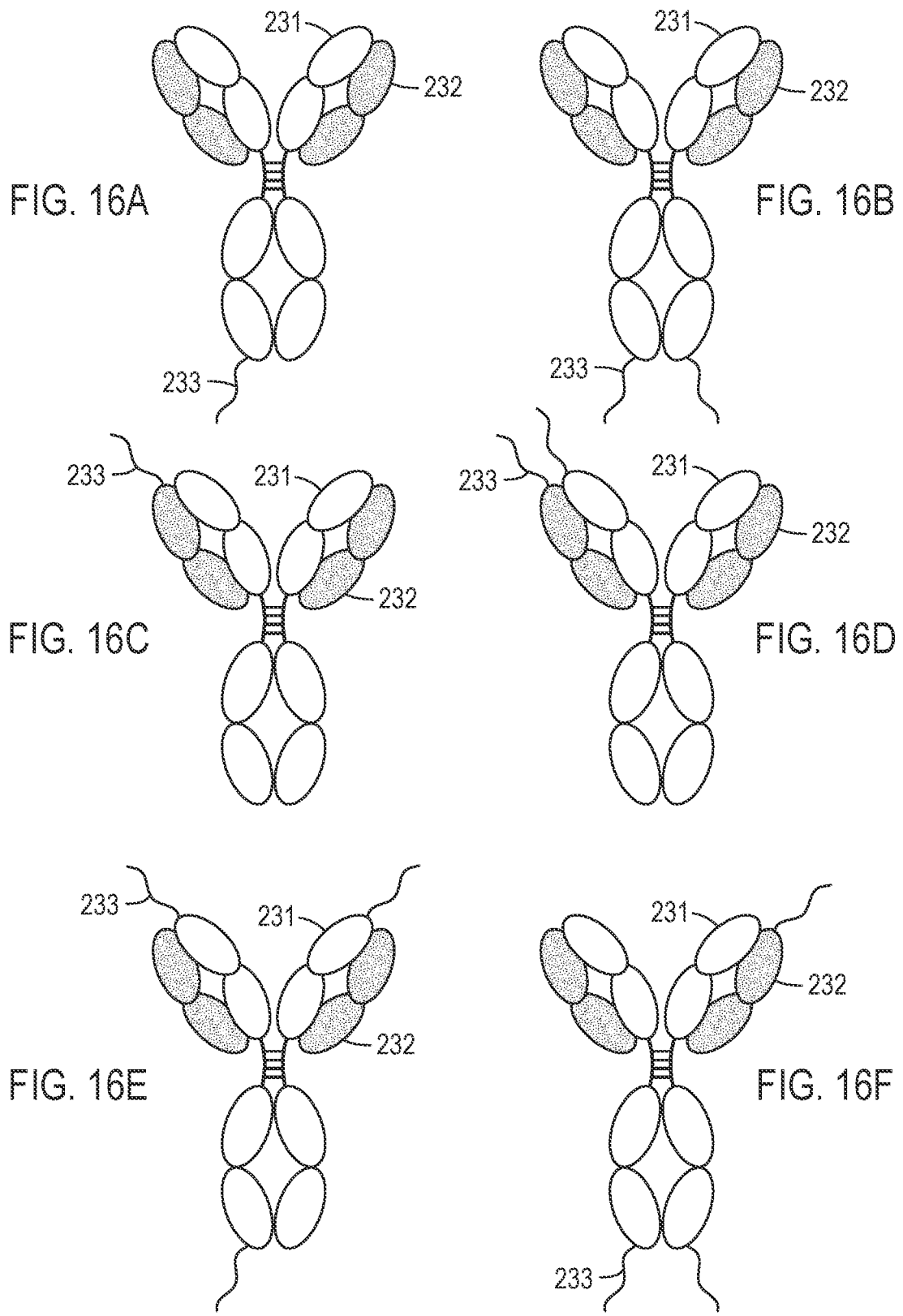

| FP50: SEQ ID NO: 1253 hIgG2-Fc IL-7Rαγc ligand fusion protein |
|---|
| APLERKSSVECPPCPAPPVAGPSVFLFPPKPKDTLMISRTPEVTCVVVDVSHEDPEVQFNWYVD GVEVHNAKTKPREEQFNSTFRVVSVLTVVHQDWLNGKEYKCKVSNKGLPAPIEKTISKTKGQ PREPQVYTLPPSREEMTKNQVSLTCLVKGFYPSDIAVEWESNGQPENNYKTTPPMLDSDGSFF LYSKLTVDKSRWQQGNVFSCSVMHEALHNHYTQKSLSLSPGARTGGGGSGGGGSIEGRGGQC IHWDIETLLSCVGGGGSGGVVCQDWEGVELCWQGG |

| FP51: SEQ ID NO: 1254 hIgG2-Fc IL-7Rαγc ligand fusion protein |
|---|
| APLERKSSVECPPCPAPPVAGPSVFLFPPKPKDTLMISRTPEVTCVVVDVSHEDPEVQFNWYVD GVEVHNAKTKPREEQFNSTFRVVSVLTVVHQDWLNGKEYKCKVSNKGLPAPIEKTISKTKGQ PREPQVYTLPPSREEMTKNQVSLTCLVKGFYPSDIAVEWESNGQPENNYKTTPPMLDSDGSFF LYSKLTVDKSRWQQGNVFSCSVMHEALHNHYTQKSLSLSPGARTGGGGSGGGGSIEGRGGVP WCTLDPGSLQCAWFGGGGSGGVVCQDWEGVELCWQGG |

| FP52: SEQ ID NO: 1255 hIgG2-Fc IL-7Rαγc ligand fusion protein |
|---|
| APLERKSSVECPPCPAPPVAGPSVFLFPPKPKDTLMISRTPEVTCVVVDVSHEDPEVQFNWYVD GVEVHNAKTKPREEQFNSTFRVVSVLTVVHQDWLNGKEYKCKVSNKGLPAPIEKTISKTKGQ PREPQVYTLPPSREEMTKNQVSLTCLVKGFYPSDIAVEWESNGQPENNYKTTPPMLDSDGSFF LYSKLTVDKSRWQQGNVFSCSVMHEALHNHYTQKSLSLSPGARTGGGGSGGGGSIEGRGGRY ECADLPGGLHCEFRGGGGSGGVVCQDWEGVELCWQGG |

| FP53: SEQ ID NO: 1256 hIgG2-Fc IL-7Rαγc ligand fusion protein |
|---|
| APLERKSSVECPPCPAPPVAGPSVFLFPPKPKDTLMISRTPEVTCVVVDVSHEDPEVQFNWYVD GVEVHNAKTKPREEQFNSTFRVVSVLTVVHQDWLNGKEYKCKVSNKGLPAPIEKTISKTKGQ PREPQVYTLPPSREEMTKNQVSLTCLVKGFYPSDIAVEWESNGQPENNYKTTPPMLDSDGSFF LYSKLTVDKSRWQQGNVFSCSVMHEALHNHYTQKSLSLSPGARTGGGGSGGGGSGGRHFDDI IPWCTLDPGSLQCAYLGGGGSGGVVCQDWEGVELCWQGG |

| FP54: SEQ ID NO: 1257 hIgG2-Fc IL-7Rαγc ligand fusion protein |
|---|
| APLERKSSVECPPCPAPPVAGPSVFLFPPKPKDTLMISRTPEVTCVVVDVSHEDPEVQFNWYVD GVEVHNAKTKPREEQFNSTFRVVSVLTVVHQDWLNGKEYKCKVSNKGLPAPIEKTISKTKGQ PREPQVYTLPPSREEMTKNQVSLTCLVKGFYPSDIAVEWESNGQPENNYKTTPPMLDSDGSFF LYSKLTVDKSRWQQGNVFSCSVMHEALHNHYTQKSLSLSPGARTGGGGSGGGGSGGHLGVP WCTLDPGSIQCAWLAKHGGGGSGGVVCQDWEGVELCWQGG |

| FP55: SEQ ID NO: 1258 hIgG2-Fc IL-7Rαγc ligand fusion protein |
|---|
| APLERKSSVECPPCPAPPVAGPSVFLFPPKPKDTLMISRTPEVTCVVVDVSHEDPEVQFNWYVD GVEVHNAKTKPREEQFNSTFRVVSVLTVVHQDWLNGKEYKCKVSNKGLPAPIEKTISKTKGQ PREPQVYTLPPSREEMTKNQVSLTCLVKGFYPSDIAVEWESNGQPENNYKTTPPMLDSDGSFF LYSKLTVDKSRWQQGNVFSCSVMHEALHNHYTQKSLSLSPGARTGGGGSGGGGSGGVVCQD WEGVELCWQGGGGSGGRHFDDIIPWCTLDPGSLQCAYLGG |

| FP56: SEQ ID NO: 1259 hIgG2-Fc IL-7Rαγc ligand fusion protein |
|---|
| APLERKSSVECPPCPAPPVAGPSVFLFPPKPKDTLMISRTPEVTCVVVDVSHEDPEVQFNWYVD GVEVHNAKTKPREEQFNSTFRVVSVLTVVHQDWLNGKEYKCKVSNKGLPAPIEKTISKTKGQ PREPQVYTLPPSREEMTKNQVSLTCLVKGFYPSDIAVEWESNGQPENNYKTTPPMLDSDGSFF |

FIG. 17A

LYSKLTVDKSRWQQGNVFSCSVMHEALHNHYTQKSLSLSPGARTGGGGSGGGGSGGVVCQD
WEGVELCWQGGGGSGGHLGVPWCTLDPGSIQCAWLAKHGG

FP1: SEQ ID NO: 1212 hIgG2-Fc IL-7Rαγc ligand fusion protein

APLERKSSVECPPCPAPPVAGPSVFLFPPKPKDTLMISRTPEVTCVVVDVSHEDPEVQFNWYVD
GVEVHNAKTKPREEQFNSTFRVVSVLTVVHQDWLNGKEYKCKVSNKGLPAPIEKTISKTKGQ
PREPQVYTLPPSREEMTKNQVSLTCLVKGFYPSDIAVEWESNGQPENNYKTTPPMLDSDGSFF
LYSKLTVDKSRWQQGNVFSCSVMHEALHNHYTQKSLSLSPGARTGSGSGSGSGSGSGSGSGS
GSGGVHRIPWCTLDPGGLQCAWLRQMGGGSGGVVCQDWEGVELCWQGG

FP57: SEQ ID NO: 1260 hIgG2-Fc IL-7Rαγc ligand fusion protein

APLERKSSVECPPCPAPPVAGPSVFLFPPKPKDTLMISRTPEVTCVVVDVSHEDPEVQFNWYVD
GVEVHNAKTKPREEQFNSTFRVVSVLTVVHQDWLNGKEYKCKVSNKGLPAPIEKTISKTKGQ
PREPQVYTLPPSREEMTKNQVSLTCLVKGFYPSDIAVEWESNGQPENNYKTTPPMLDSDGSFF
LYSKLTVDKSRWQQGNVFSCSVMHEALHNHYTQKSLSLSPGARTGSGSGSGSGSGSGSGSGS
GSGGHCKHWDLESLLLCVGGGGSGGVVCQDWEGVELCWQGG

FP58: SEQ ID NO: 1261 hIgG2-Fc IL-7Rαγc ligand fusion protein

ERKSSVECPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPGAGSGSGSGSGSGSGSGSGSGSGGQC
VHWDLDTLFGCIREQLELGGGGSGGVVCQDWEGVELCWQGG

FP59: SEQ ID NO: 1262 hIgG2-Fc IL-7Rαγc ligand fusion protein

ERKSSVECPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPGAGSGSGSGSGSGSGSGSGSGSGGVV
CQDWEGVELCWQGGGGSGGQCVHWDLDTLFGCIREQLELGG

FP60: SEQ ID NO: 1263 hIgG2-Fc IL-7Rαγc ligand fusion protein

ERKSSVECPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPGAGSGSGSGSGSGSGSGSGSGSGGIRS
CLWQPGALHCTWWAEEEPVGGGGSGGVVCQDWEGVELCWQGG

FP61: SEQ ID NO: 1264 hIgG2-Fc IL-7Rαγc ligand fusion protein

ERKSSVECPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPGAGSGSGSGSGSGSGSGSGSGSGGVV
CQDWEGVELCWQGGGGSGGIRSCLWQPGALHCTWWAEEEPVGG

FIG. 17B

| FP62: SEQ ID NO: 1265 hIgG2-Fc IL-7Rαγc ligand fusion protein |
|---|
| ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGGIPWCLLDPGGLQCVWLGGGGSGGVVCQDWEGVELCWQGG |
| FP63: SEQ ID NO: 1266 hIgG2-Fc IL-7Rαγc ligand fusion protein |
| ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGGVVCQDWEGVELCWQGGGGSGGIPWCLLDPGGLQCVWLGG |
| FP8: SEQ ID NO: 1219 PEM HC IL-7Rαγc ligand fusion protein |
| QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGAGSGSGSGSGSGSGSGSGSGGVHRIPWCTLDPGGLQCAWLRQMGGGGSGGVVCQDWEGVELCWQGG |
| FP64: SEQ ID NO: 1267 hIgG1-Fc-hole IL-7Rαγc ligand fusion protein |
| DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGGSGSGSGSGSGSGSGSGSGGVHRIPWCTLDPGGLQCAWLRQMGGGGSGGVVCQDWEGVELCWQGG |
| FP65: SEQ ID NO: 1268 hIgG1-Fc-hole IL-7Rαγc ligand fusion protein |
| AKTEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGGSGSGSGSGSGSGSGSGSGGVHRIPWCTLDPGGLQCAWLRQMGGGGSGGVVCQDWEGVELCWQGG |
| FP14: SEQ ID NO: 1225 hIgG2 -Fc IL-7Rαγc ligand fusion protein |
| ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGGVHRIPWCTLDPGGLQCAWLRQMGGGGSGGVVCQDWEGVELCWQGG |
| FP66: SEQ ID NO: 1269 hIgG2-Fc IL-7Rαγc ligand fusion protein |
| ERKSSVECPPCPAPPVAGPSVFLFPPKPKDTLMISRTPEVTCVVVDVSHEDPEVQFNWYVDGVE |

FIG. 17C

VHNAKTKPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPGAGSGSGSGSGSGSGSGSGSGGVH
RIPWCTLDPGGLQCAWLRGGGGSGGVVCQDWEGVELCWQGG

FP67: SEQ ID NO: 1270 hIgG2-Fc IL-7Rαγc ligand fusion protein

ERKSSVECPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPGAGSGSGSGSGSGSGSGSGSGGGW
GIPWCTLDPGSLQCAWLGKHGGGGSGGVVCQDWEGVELCWQGG

FP68: SEQ ID NO: 1271 hIgG2-Fc IL-7Rαγc ligand fusion protein

ERKSSVECPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPGAGSGSGSGSGSGSGSGSGSGGVH
RIPWCTLDPGGLQCAWLRQGGGGSGGVVCQDWEGVELCWQGG

FP69: SEQ ID NO: 1272 hIgG2-Fc IL-7Rαγc ligand fusion protein

ERKSSVECPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPGAGSGSGSGSGSGSGSGSGSGGVH
RIPWCTLDPGGLQCAWLRMGGGGSGGVVCQDWEGVELCWQGG

FP70: SEQ ID NO: 1273 hIgG2-Fc IL-7Rαγc ligand fusion protein

ERKSSVECPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPGAGSGSGSGSGSGSGSGSGSGGVH
RIPWCTLDPGGLQCAWIRQMGGGGSGGVVCQDWEGVELCWQGG

FP71: SEQ ID NO: 1274 hIgG2-Fc IL-7Rαγc ligand fusion protein

ERKSSVECPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPGAGSGSGSGSGSGSGSGSGSGGVH
RIPWCTLDPGGLQCAWVRQMGGGGSGGVVCQDWEGVELCWQGG

FP72: SEQ ID NO: 1275 hIgG2-Fc IL-7Rαγc ligand fusion protein

ERKSSVECPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKTKGQPREP
QVYTLPPSREEMTKNQVSLTCLVKGFYPSDIAVEWESNGQPENNYKTTPPMLDSDGSFFLYSK
LTVDKSRWQQGNVFSCSVMHEALHNHYTQKSLSLSPGAGSGSGSGSGSGSGSGSGSGGVH
RIPWCTLDPGGLQCAWARQMGGGGSGGVVCQDWEGVELCWQGG

FIG. 17D

IL-7R-α-γ BINDING COMPOUNDS

This application is a continuation of U.S. application Ser. No. 17/166,462, filed on Feb. 3, 2021, now allowed, which claims the benefit under 35 U.S.C. § 119(e) of U.S. Provisional Application No. 63/041,158, filed on Jun. 19, 2020, and U.S. Provisional Application No. 62/969,432, filed on Feb. 3, 2020, each of which is incorporated by reference in its entirety.

FIELD

The present disclosure relates to IL-7Rαγc binding compounds. The IL-7Rαγc binding compounds can function as IL-7R agonists or partial IL-7R agonists or antagonists.

SEQUENCE LISTING

This application includes a Sequence Listing XML which has been submitted electronically in XML format and is incorporated by reference in its entirety. The Sequence Listing XML, created on Dec. 7, 2022, is named 62AJ-000820US-374512 Sequence Listing Jul-25-2023.xml, which is 2,493 kilobytes in size.

BACKGROUND

Interleukin-7 (IL-7) is required for development and maintenance of T-cell homeostasis and plays an important role in the establishment of the B-cell repertoire. Unlike most interleukins, IL-7 is primarily produced by non-hematopoietic stromal cells rather than leukocytes. Under normal conditions, free IL-7 levels are limiting, but accumulate during lymphopenia, leading to increased T cell proliferation and replenishment of T-cell populations. Under certain physiological conditions, recombinant human IL-7 administered to humans, non-human primates and mice, produces widespread T cell proliferation, increased T cell numbers, modulation of peripheral T cell subsets and increased T cell receptor repertoire diversity. These effects may be therapeutically useful in a variety of clinical settings.

IL-7 is a member of the common γ chain (γc, CD132) family of cytokines that includes interleukin-2 (IL-2), IL-4, IL-7, IL-9, IL-15, and IL-21. IL-7 signals via an active complex formed with its unique α-receptor, IL-7Rα (CD127), and the common γc receptor (Rγc). Receptor activation leads to signaling through an array of pathways, including JAK-STAT, P13K-AKT, and Src kinases.

The IL-7Rα receptor subunit exists in two states: a full-length membrane-bound form that, with Rγc, mediates IL-7R signal transduction; and soluble (alternatively-spliced, secreted, or shed) forms of the extracellular domain that may provide regulation of extracellular IL-7 levels and modulation of IL-7R signaling.

The cell surface signaling-competent form of IL-7Rα is expressed on most resting T-cells and is down regulated upon T-cell activation, while naïve memory T-cells continue to express IL-; and regulatory cells typically express very low levels of IL-7Rα. IL-7R signaling is necessary for long-term maintenance of T cell populations, in part by modulating apoptosis. Both CD4+ and CD8+ memory T-cells are dependent on IL-7 for long-term survival.

Emerging evidence suggests IL-7R agonists may be useful in immuno-oncology therapy. For example, IL-7 is effective in increasing cytotoxic CD8+T lymphocytes (CD8+ T-cell), and long-term tumor antigen specific CD8+ T-cell responses are enhanced by IL-7 treatment.

IL-7 exhibits inhibitory effects in tumors such as glioma, melanoma, lymphoma, leukemia, prostate cancer, and glioblastoma; and administration of IL-7 in murine tumor models has shown decreased cancer cell growth. IL-7 has been shown to enhance the antitumor effect of interferon-γ (IFNγ) in rat glioma tumors, and can induce the production of IL-1α, IL-1β, and TNF-α by monocytes, which can inhibit tumor growth.

IL-7 has been shown to have potential in the treatment of lymphopenias, septic shock, and infectious disease as well immune deficiencies of aging (immuno-senescence), and enhancement of response to vaccination. IL-7 prevents or reverses T-cell exhaustion and induces rejuvenation and increased activity of transferred CAR-T cells. IL-7 is currently being studied to prevent or reverse lymphopenia associated with COVID-19. IL-7/IL-7R signaling has also been implicated in autoimmune, chronic inflammatory diseases, and cancer, and therefore therapeutic targeting of the IL-7/IL-7R pathway is expected to have clinical benefit.

Importantly, administration of recombinant IL-7 has been found to be well tolerated in clinical trials.

SUMMARY

According the present disclosure IL-7Rαγc ligands and IL-7Rαγc constructs comprise:
(a) an IL-7Rα ligand, wherein the IL-7Rα ligand comprises an amino acid sequence of Formula (1) (SEQ ID NO: 389), Formula (1a) (SEQ ID NO: 390), Formula (1b) (SEQ ID NO: 391), or Formula (1c) (SEQ ID NO: 392);

(1)
$-X^{201}-X^{202}-X^{203}-X^{204}-X^{205}-X^{206}-X^{207}-X^{208}-X^{209}-X^{210}-X^{211}-X^{212}-X^{213}-X^{214}-X^{215}-X^{216}-$ (1a)
$-X^{202}-X^{203}-X^{204}-X^{205}-X^{206}-X^{207}-X^{208}-X^{209}-X^{210}-X^{211}-X^{212}-X^{213}-X^{214}-X^{215}-$ (1b)
$-X^{203}-X^{204}-X^{205}-X^{206}-X^{207}-X^{208}-X^{209}-X^{210}-X^{211}-X^{212}-X^{213}-X^{214}-$ (1c)
$-X^{204}-X^{205}-X^{206}-X^{207}-X^{208}-X^{209}-X^{210}-X^{211}-X^{212}-X^{213}-$ wherein,
$X^{201}$ is selected from H, I, Q, and V;
$X^{202}$ is selected from C, P, and R;
$X^{203}$ is selected from I, K, L, S, V, and W;
$X^{204}$ is selected from C and H;
$X^{205}$ is selected from A, I, L, M, T, and W;
$X^{206}$ is selected from D, L, and W;
$X^{207}$ is selected from D, I, L, and Q;
$X^{208}$ is selected from D, E, and P;
$X^{209}$ is selected from G, S, and T;
$X^{210}$ is selected from A, G, L, and S;
$X^{211}$ is selected from F, I, L, and M;
$X^{212}$ is selected from G, H, L, N, Q, and S;
$X^{213}$ is C;
$X^{214}$ is selected from A, E, I, L, S, T, and V;
$X^{215}$ is selected from F, R, W, and Y; and
$X^{216}$ is selected from E, L, Q, and W; and (b) an Rγc ligand, wherein the Rγc ligand comprises an amino acid sequence of Formula (3) (SEQ ID NO: 944), Formula (3a) (SEQ ID NO: 945), Formula (3b) (SEQ ID NO: 946), Formula (3c) (SEQ ID NO: 947), Formula (3d) (SEQ ID NO: 948), or Formula (3e) (SEQ ID NO: 949):

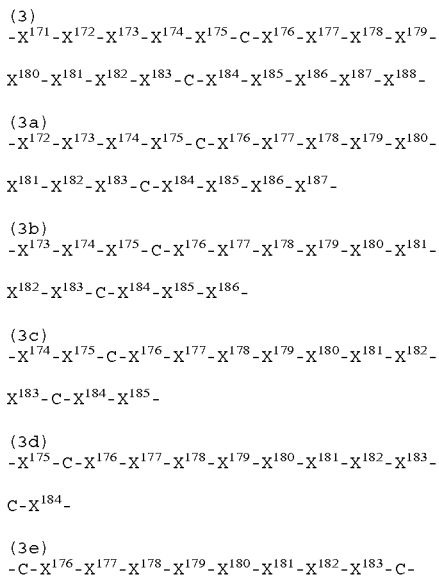

$$(3)\ \text{-}X^{171}\text{-}X^{172}\text{-}X^{173}\text{-}X^{174}\text{-}X^{175}\text{-}C\text{-}X^{176}\text{-}X^{177}\text{-}X^{178}\text{-}X^{179}\text{-}X^{180}\text{-}X^{181}\text{-}X^{182}\text{-}X^{183}\text{-}C\text{-}X^{184}\text{-}X^{185}\text{-}X^{186}\text{-}X^{187}\text{-}X^{188}\text{-}$$

$$(3a)\ \text{-}X^{172}\text{-}X^{173}\text{-}X^{174}\text{-}X^{175}\text{-}C\text{-}X^{176}\text{-}X^{177}\text{-}X^{178}\text{-}X^{179}\text{-}X^{180}\text{-}X^{181}\text{-}X^{182}\text{-}X^{183}\text{-}C\text{-}X^{184}\text{-}X^{185}\text{-}X^{186}\text{-}X^{187}\text{-}$$

$$(3b)\ \text{-}X^{173}\text{-}X^{174}\text{-}X^{175}\text{-}C\text{-}X^{176}\text{-}X^{177}\text{-}X^{178}\text{-}X^{179}\text{-}X^{180}\text{-}X^{181}\text{-}X^{182}\text{-}X^{183}\text{-}C\text{-}X^{184}\text{-}X^{185}\text{-}X^{186}\text{-}$$

$$(3c)\ \text{-}X^{174}\text{-}X^{175}\text{-}C\text{-}X^{176}\text{-}X^{177}\text{-}X^{178}\text{-}X^{179}\text{-}X^{180}\text{-}X^{181}\text{-}X^{182}\text{-}X^{183}\text{-}C\text{-}X^{184}\text{-}X^{185}\text{-}$$

$$(3d)\ \text{-}X^{175}\text{-}C\text{-}X^{176}\text{-}X^{177}\text{-}X^{178}\text{-}X^{179}\text{-}X^{180}\text{-}X^{181}\text{-}X^{182}\text{-}X^{183}\text{-}C\text{-}X^{184}\text{-}$$

$$(3e)\ \text{-}C\text{-}X^{176}\text{-}X^{177}\text{-}X^{178}\text{-}X^{179}\text{-}X^{180}\text{-}X^{181}\text{-}X^{182}\text{-}X^{183}\text{-}C\text{-}$$

wherein,
$X^{171}$ is selected from H, K, and R;
$X^{172}$ is selected from S, T, and Y;
$X^{173}$ is selected from D, E, F, I, L, M, V, W, and Y;
$X^{174}$ is selected from F, I, L, M, V, W, and Y;
$X^{175}$ is selected from D, E, F, I, L, M, V, W, and Y;
$X^{176}$ is selected from D, E, H, N, Q, S, T, and Y;
$X^{177}$ is selected from D and E;
$X^{178}$ is selected from F, H, I, L, M, V, W, and Y;
$X^{179}$ is selected from D, E, H, N, Q, S, T, and Y;
$X^{180}$ is G;
$X^{181}$ is V;
$X^{182}$ is E;
$X^{183}$ is L;
$X^{184}$ is selected from W;
$X^{185}$ is selected from F, I, L, M, V, W, Y, H, N, Q, S, and T;
$X^{186}$ is E;
$X^{187}$ is selected from an amino acid; and
$X^{188}$ is selected from D and E.

According to the present invention, tandem IL-7Rαγc ligands comprise two or more IL-7Rαγc ligands provided by the present disclosure.

According to the present invention, IL-7Rαγc ligand constructs comprise one or more of the IL-7Rαγc ligands provided by the present disclosure.

According to the present invention, methods of treating cancer, an inflammatory disease, and autoimmune diseases, or an immune deficiency disease in a patient comprise administering to a patient in need of such treatment a therapeutically effective amount of an IL-7Rαγc binding compound provided by the present disclosure.

According to the present invention, methods of expanding immune cells comprise contacting a population of immune cells ex vivo or in vivo with an effective amount of an IL-7Rαγc binding compound provided by the present disclosure.

According to the present invention, methods of augmenting a vaccine comprise administering to a patient a vaccine and a therapeutically effective amount of an IL-7Rαγc binding compound provided by the present disclosure.

According to the present invention, methods of modifying the immune response comprise administering to a patient an effective amount of an IL-7Rαγc binding compound provided by the present disclosure.

According to the present invention, pharmaceutical compositions comprise an IL-7Rαγc binding compound provided by the present disclosure.

According to the present invention, nucleic acids encoding for an IL-7Rαγc binding compound are provided.

BRIEF DESCRIPTION OF THE DRAWINGS

The drawings described herein are for illustration purposes only. The drawings are not intended to limit the scope of the present disclosure.

FIGS. 13A-13B show the amino acid sequences and linker structures for certain IL-7Rαγc ligands provided by the present disclosure.

FIGS. 14A-14D show the amino acid sequences for certain protein and IL-7Rαγc ligand fusion constructs provided by the present disclosure. FIG. 14 also discloses "(GS)$_{10}$" as SEQ ID NO: 9407, "(PA)$_{10}$" as SEQ ID NO: 9428, "(GGGGS)" as SEQ ID NO: 9395, "(GGGGS)$_3$" as SEQ ID NO: 9397, "(GGGGS)$_4$" as SEQ ID NO: 9398, "(G)$_5$" as SEQ ID NO: 9406, "(PA)$_5$" as SEQ ID NO: 9426, and "(PA)$_7$" as SEQ ID NO: 9427.

FIGS. 16A-16F show examples of various configurations of IL-7Rαγc ligand immunoglobulin fusion proteins provided by the present disclosure.

FIGS. 17A-17D show the amino acid sequences for certain protein and IL-7Rαγc ligand fusion constructs provided by the present disclosure.

DETAILED DESCRIPTION

Figure 1:
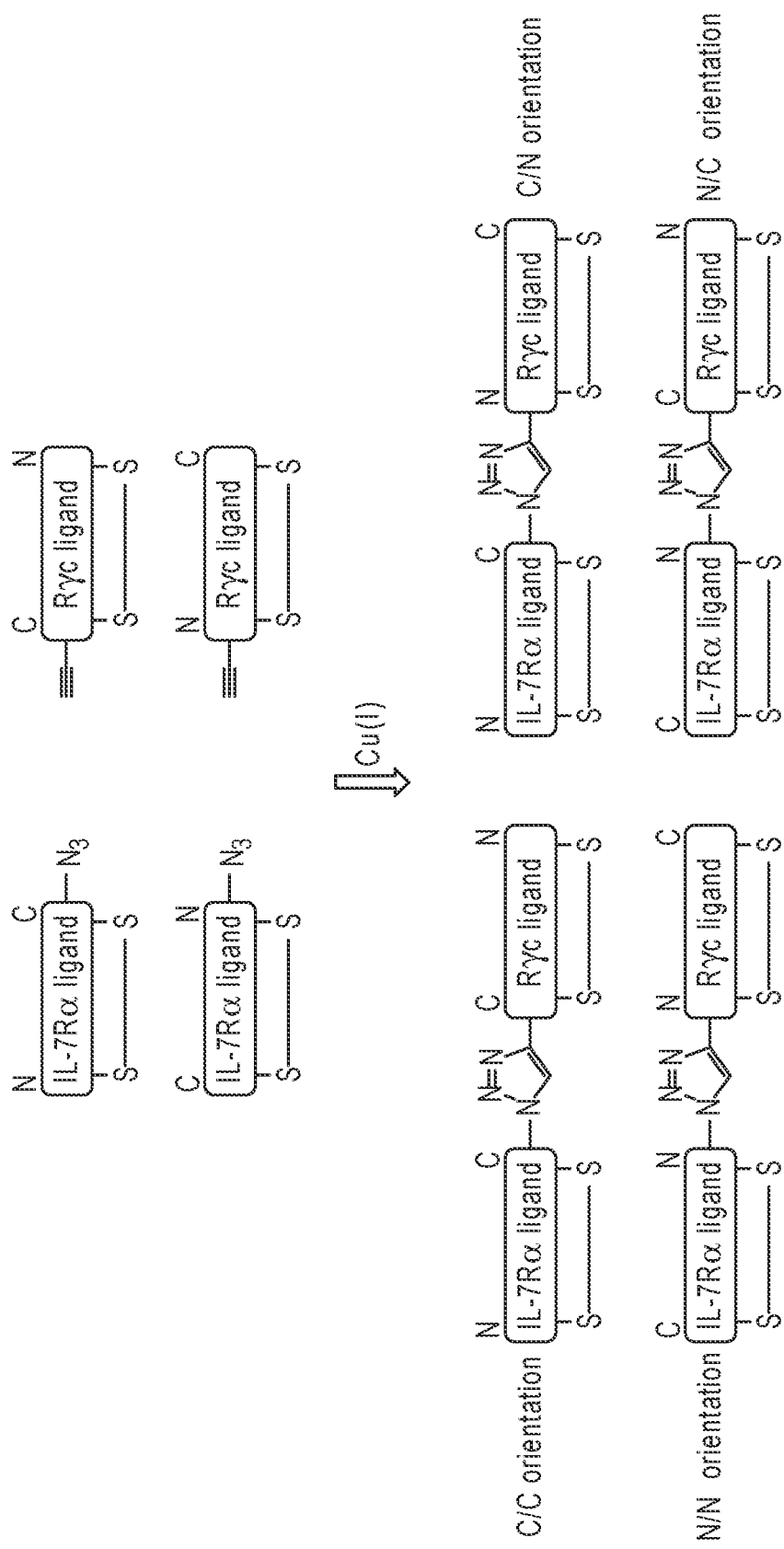
FIG. 1 shows examples of IL-7Rαγc ligands in which the individual IL-7Rα and Rγc ligands are attached via their respective N- and C-termini in the four possible orientations: C-to-N, C-to-C, N-to-C, or N-to-N.

A dash ("-") that is not between two letters or symbols is used to indicate a point of attachment for a moiety or substituent. For example, —CONH$_2$ is attached to a compound through the carbon atom and —X$^1$—X$^2$— denotes amino acids X$^1$ and X$^2$ covalently bound through a single bond.

"Alkyl" refers to a saturated, branched or straight-chain, monovalent hydrocarbon radical derived by the removal of one hydrogen atom from a single carbon atom of a parent alkane, alkene, or alkyne. An alkyl group is C$_{1-6}$ alkyl, C$_{1-5}$ alkyl, C$_{1-4}$ alkyl, C$_{1-3}$ alkyl, and in certain embodiments, ethyl or methyl.

"Cycloalkyl" refers to a saturated or partially unsaturated cyclic alkyl radical. A cycloalkyl can be, for example, C$_{3-6}$ cycloalkyl, C$_{3-5}$ cycloalkyl, C$_{5-6}$ cycloalkyl, cyclopropyl, cyclopentyl, and in certain embodiments, cyclohexyl. Cycloalkyl can be selected from cyclopropyl, cyclobutyl, cyclopentyl, and cyclohexyl.

"Cyclized" refers to a reaction in which one part of a peptide or polypeptide molecule becomes linked to another part of the peptide or polypeptide molecule to form a closed ring, such as by forming a disulfide bridge or other similar bond, such as a lactam bond. Peptide monomer compounds or monomer subunits of peptide dimer compounds can be cyclized via an intramolecular bond between two amino acid residues present in the peptide monomer or monomer subunit. A peptide such as an IL-7Rαγc ligand can include cysteines that are bound together through disulfide bonds and thereby are cyclized IL-7Rαγc ligands.

"Heterocycloalkyl" by itself or as part of another substituent refers to a saturated cyclic alkyl radical in which one or more carbon atoms (and certain associated hydrogen atoms) are independently replaced with the same or different heteroatom; or to a parent aromatic ring system in which one or more carbon atoms (and certain associated hydrogen atoms) are independently replaced with the same or different heteroatom such that the ring system violates the Hückel-rule. Examples of heteroatoms to replace the carbon atom(s) include N, P, O, S, and Si. Examples of heterocycloalkyl groups include groups derived from epoxides, azirines, thiiranes, imidazolidine, morpholine, piperazine, piperidine, pyrazolidine, pyrrolidine, quinuclidine, and the like. A heterocycloalkyl can be C$_5$ heterocycloalkyl and is selected from pyrrolidinyl, tetrahydrofuranyl, tetrahydrothiophenyl, imidazolidinyl, oxazolidinyl, thiazolidinyl, doxolanyl, and dithiolanyl. A heterocycloalkyl can be C$_6$ heterocycloalkyl and is selected from piperidinyl, tetrahydropyranyl, piperizinyl, oxazinyl, dithianyl, and dioxanyl. A heterocycloalkyl group can be C$_{3-6}$ heterocycloalkyl, C$_{3-5}$ heterocycloalkyl, C$_{5-6}$ heterocycloalkyl, and in certain embodiments, C$_5$ heterocycloalkyl or C$_6$ heterocycloalkyl. A heteroatomic group can be selected from —O—, —S—, —NH—, —N(—CH$_3$)—, —SO—, and —SO$_2$—, in certain embodiments, a heteroatomic group is selected from —O— and —NH—, and in certain embodiments a heteroatomic group is —O— or —NH—.

"Binding affinity" refers to the strength of the binding interaction between a single biomolecule and its ligand/binding partner. Binding affinity is expressed as the IC$_{50}$. For example, binding affinity of a compound such as an IL-7Rαγc ligand or an IL-7Rαγc ligand construct refers to the IC$_{50}$ as determined using, for example, a method described in the examples.

"Direct binding" refers to the binding interaction between a single biomolecule and its binding partner such as the interaction of an IL-7Rα ligand and the hIL-7Rα subunit. Direct binding can be determined using phage ELISA assays.

"Agonist" refers to a biologically active ligand which binds to its complementary biologically active receptor or subunit(s) and activates the receptor to cause a biological response mediated by the receptor, or to enhance a preexisting biological activity mediated by the receptor.

"Partial agonist" refers to a compound that provides a level of activation, that is, for example, less than 75% of maximum activation, less than 50%, less than 25%, less than 10%, or less than 1% of the maximum activation. A partial IL-7R agonist exhibits a level of activation that is less than the level of activation provided by IL-7.

"Antagonist" refers to a biologically active ligand or compound that binds to its complementary receptor or subunit(s) and blocks or reduces a biological response of the receptor. An IL-7R antagonist binds to IL-7R with an IC$_{50}$ of less than 100 μM and inhibits functional activity of IL-7 as determined, for example, using any of the functional assays disclosed in the examples.

Amino acid residues are abbreviated as follows: alanine is Ala or A; arginine is Arg is R; asparagine is Asn or N; aspartic acid is Asp or D; cysteine is Cys or C; glutamic acid is Glu or E; glutamine is Gln or Q; glycine is Gly or G; histidine is His or H; isoleucine is Ile or I; leucine is Leu or L; lysine is Lys or K; methionine is Met or M; phenylalanine is Phe or F; proline is Pro or P; serine is Ser or S; threonine is Thr or T; tryptophan is Trp or W; tyrosine is Tyr or Y; and valine is Val or V.

"Non-natural amino acids" include, for example, R-amino acids, homo-amino acids, proline and pyruvic acid derivatives, histidine derivatives with alkyl or heteroatom moieties attached to the imidazole ring, amino acids with pyridine-containing side chains, 3-substituted alanine derivatives, glycine derivatives, ring-substituted phenylalanine and tyrosine derivatives, and N-methyl amino acids.

Amino acids having a large hydrophobic side chain include isoleucine (I), leucine (L), methionine (M), valine (V), phenylalanine (F), tyrosine (Y), and tryptophan (W).

Amino acids having a small hydrophobic side chain include alanine (A), glycine (G), proline (P), serine (S), and threonine (T).

Amino acids having a basic side chain include arginine (R), lysine (K), and histidine (H).

Amino acids having an acidic side chain include aspartate (D) and glutamate (E).

Amino acids having a polar/neutral side chain include histidine (H), asparagine (N), glutamine (Q), serine (S), threonine (T), and tyrosine (Y).

Amino acids having an aromatic side chain include phenylalanine (F), histidine (H), tryptophan (W), and tyrosine (Y).

Amino acids having a hydroxyl side chain include serine (S), threonine (T), and tyrosine (Y).

"Conservative amino acid substitution" means that amino acids within each of the following groups can be substituted with another amino acid within the group: amino acids having a small hydrophobic side chain comprising alanine (A), glycine (G), proline (P), serine (S), and threonine (T); amino acids having a hydroxyl-containing side chain comprising serine (S), threonine (T), and tyrosine (Y); amino acids having an acidic side chain comprising aspartate (D) and glutamate (E); amino acids comprising a polar-neutral side chain comprising histidine (H), asparagine (N), glutamine (Q), serine (S), threonine (T), and tyrosine (Y); amino acids having a basic side chain comprising arginine (R), lysine (K), and histidine (H); amino acids having a large hydrophobic side chain comprising isoleucine (I), leucine (L), methionine (M), valine (V), phenylalanine (F), tyrosine (Y), and tryptophan (W)); and amino acids having an aromatic side chain comprising phenylalanine (F), histidine (H), tryptophan (W), and tyrosine (Y).

An "enzymatically degradable linkage" refers to a chemical linkage that can be degraded or cleaved by one or more enzymes.

A "hydrolytically stable" linkage or bond refers to a chemical bond, such as a covalent bond, that is substantially stable in water such that the chemical bond does not undergo hydrolysis under physiological conditions to any appreciable extent over an extended period of time. Examples of hydrolytically stable linkages include, but are not limited to, the following: carbon-carbon bonds (e.g., in aliphatic chains), ethers, amides, urethanes, and the like. Generally, a hydrolytically stable linkage is one that exhibits a rate of hydrolysis of less than about 1% to 2% per day under physiological conditions.

An "IL-7Rα ligand" refers to a peptide capable of binding to the IL-7Rα subunit of a mammalian IL-7 receptor, such as a human IL-7 receptor, with an $IC_{50}$ of less than 100 μM.

An "Rγc ligand" refers to a peptide capable of binding to the Rγc subunit of a mammalian IL-7 receptor, such as a human IL-7 receptor, with an ($IC_{50}$ of less than 100 μM.

The "hIL-7Rα subunit" refers to the human (*Homo sapiens*) interleukin-7 receptor subunit α precursor NCBI Reference Sequence NP_002176.2.

The "Rγc subunit" refers to the human (*Homo sapiens*) interleukin-7 receptor subunit γc precursor NCBI Reference Sequence NP_000197.1.

An "IL-7R ligand fusion protein" refers to a protein made by recombinant DNA technology in which the translational reading frame of a ligand of a mammalian IL-7 receptor is fused in frame to that of another protein, i.e., the IL-7R ligand fusion partner, to produce a single recombinant polypeptide. An IL-7R ligand fusion protein can comprise an IL-7Rα ligand and an Rγc ligand, an IL-7Rαγc ligand, and/or a tandem IL-7Rαγc ligand. An IL-7R-fusion partner can be the Fc domain of an IgG molecule where the IL-7Rαγc ligand is bonded to the two C-termini of the Fc structure. An IL-7R ligand fusion protein can include a peptidyl linker such as an amino acid sequence located between an IL-7R ligand and a fusion protein partner comprising a fusion protein, such that the peptidyl linker amino acid sequence is not derived from either the IL-7R ligand or the fusion protein partner. Peptidyl linkers can be incorporated into fusion proteins as spacers to promote proper protein folding and stability of the component protein moieties, to improve protein expression, and/or to enable better bioactivity of the two fusion partners. Peptidyl linkers can include, for example, a flexible peptide or a rigid peptide.

An "IL-7Rαγc ligand" refers to a compound consisting of or comprising one or more IL-7Rα ligands and one or more Rγc ligands. The one or more IL-7Rα ligands and one or more Rγc ligands can be bound to an IL-7Rαγc ligand linker. An IL-7Rαγc ligand can comprise a tandem IL-7Rαγc ligand comprising two or more IL-7Rαγc ligands, or an IL-7Rαγc ligand can comprise a single ligand that simultaneously binds to both the IL-7Rα subunit and the Rγc subunit. An IL-7Rαγc ligand is capable of binding to the IL-7Rα subunit and to the Rγc subunit of IL-7R with an $IC_{50}$ of less than 100 μM. An "IL-7Rαγc ligand construct" refers to a compound comprising one or more IL-7Rαγc ligands bound to a construct partner. An IL-7Rαγc ligand construct also includes compounds in which one or more IL-7Rα ligands and one or more Rγc ligands are bound to a construct partner.

An "IL-7Rαγc binding compound" refers to an IL-7Rαγc ligand, a tandem IL-7Rαγc ligand, an IL-7Rαγc ligand construct, and to a construct comprising at least one IL-7Rα ligand and at least one Rγc ligand.

Bioisosteres are atoms or molecules that fit the broadest definition for isosteres. The concept of bioisosterism is based on the concept that single atom, groups, moieties, or whole molecules, which have chemical and physical similarities produce similar biological effects. A bioisostere of a parent compound can still be recognized and accepted by its appropriate target, but its functions will be altered as compared to the parent molecule. Parameters influenced by bioisosteric replacements include, for example, size, conformation, inductive and mesomeric effects, polarizability, capacity for electrostatic interactions, charge distribution, H-bond formation capacity, pKa (acidity), solubility, hydrophobicity, lipophilicity, hydrophilicity, polarity, potency, selectivity, reactivity, or chemical and metabolic stability, ADME (absorption, distribution, metabolism, and excretion). Although common in pharmaceuticals, carboxyl groups or carboxylic acid functional groups (—$CO_2H$) in a parent molecule may be replaced with a suitable surrogate or (bio)isostere to overcome chemical or biological shortcomings while retaining the desired attributes of the parent molecule bearing one or more carboxyl groups or carboxylic acid functional groups (—$CO_2H$). IL-7Rαγc ligands include bioisosteres of the IL-7Rαγc ligands provided by the present disclosure "Isostere" or "isostere replacement" refers to any amino acid or other analog moiety having physiochemical and/or structural properties similar to a specified amino acid. An "isostere" or "suitable isostere" of an amino acid is another amino acid of the same class, wherein amino acids belong to the following classes based on the propensity of the side chain to be in contact with polar solvent like water: hydrophobic (low propensity to be in contact with water), polar or charged (energetically favorable contact with water). Examples of charged amino acid residues include lysine (+), arginine (+), aspartate (−) and glutamate (−). Examples of polar amino acids include serine, threonine, asparagine, glutamine, histidine and tyrosine. Illustrative hydrophobic amino acids include alanine, valine, leucine, isoleucine, proline, phenylalanine, tryptophan, cysteine and methionine. The amino acid glycine does not have a side chain and is difficult to assign to one of the above classes. However, glycine is often found at the surface of proteins, often within loops, providing high flexibility to these regions, and an isostere may have a similar feature. Proline has the opposite effect, providing rigidity to the protein structure by imposing certain torsion angles on the segment of the polypeptide chain. An isostere can be a derivative of an amino acid, e.g., a derivative having one or more modified side chains as compared to the reference amino acid. IL-7Rαγc ligands include isosteres of the IL-7Rαγc ligands provided by the present disclosure.

"Patient" refers to a mammal, for example, a human.

"PEG," "polyethylene glycol" and "poly(ethylene glycol)" refer to any suitable nonpeptidic water-soluble poly (ethylene oxide). PEGs can comprise a structure —(OCH$_2$CH$_2$)$_n$— where n is, for example, an integer from 1 to 4,000. A PEG can also include moieties such as —CH$_2$CH$_2$—O(CH$_2$CH$_2$O)$_n$ CH$_2$CH$_2$— and/or —(OCH$_2$CH$_2$)$_n$O—, depending upon whether or not the terminal oxygens have been displaced, e.g., during a synthetic transformation. A PEG can be capped with a suitable end group. At least 50% of the repeating subunits of a PEG can have the structure —CH$_2$CH$_2$—. A PEG can have any suitable molecular weight, structure, and/or geometry such as branched, linear, forked, or multifunctional.

"Peptide" refers to a polymer in which the monomers include amino acids joined together through amide bonds. A peptide can comprise, for example, less than 200 amino acids, less than 100 amino acids, less than 50 amino acids, less than 40 amino acids, less than 30 amino acids, or less than 20 amino acids. A peptide can comprise naturally occurring amino acids, non-naturally occurring amino acids, or a combination thereof.

In addition to peptides consisting only of naturally occurring amino acids, peptidomimetics or peptide analogs are also provided. A peptide mimetic can be functionally and/or structurally similar to another peptide. Peptide mimetics that are functionally and/or structurally similar to therapeutically useful peptides may be used to produce an equivalent or enhanced therapeutic or prophylactic effect. Generally, peptidomimetics can be structurally similar to a paradigm peptide, for example, a peptide that has a biological or pharmacological activity, such as a naturally occurring receptor-binding peptide, but have one or more peptide linkages optionally replaced by a linkage such as —CH$_2$—NH—, —CH$_2$—S—, —CH$_2$—CH$_2$—, —CH═CH— (cis and trans), —COCH$_2$—, —CH(OH)CH$_2$—, and —CH$_2$SO—, by methods known in the art.

Substitution of one or more amino acids of a consensus sequence with a D-amino acid of the same type, such as D-lysine in place of L-lysine, may be used to generate more stable peptides. In addition, constrained peptides comprising a consensus sequence, or a substantially identical consensus sequence variation may be generated by methods known in the art; for example, by adding internal cysteine residues capable of forming intramolecular disulfide bridges which cyclize the peptide.

Synthetic or non-naturally occurring amino acids refer to amino acids that do not naturally occur in vivo but which, nevertheless, can be incorporated into the peptide ligands provided by the present disclosure. Suitable examples of synthetic amino acids include the D-α-amino acids of naturally occurring L-α-amino acid as well as non-naturally occurring D- and L-α-amino acids represented by the formula H$_2$NCHR$^5$COOH where R is C$_{1-6}$ alkyl, C$_{3-8}$ cycloalkyl, C$_{3-8}$ heterocycloalkyl; an aromatic residue of from 6 to 10 carbon atoms optionally having from 1 to 3 substituents on the aromatic nucleus selected from hydroxyl, lower alkoxy, amino, and carboxyl; -alkylene-Y where alkylene is an alkylene group of from 1 to 7 carbon atoms and Y is selected from a hydroxyl, amino, cycloalkyl, and cycloalkenyl having from 3 to 7 carbon atoms; aryl of from 6 to 10 carbon atoms, such as from 1 to 3 substituents on the aromatic nucleus selected hydroxyl, lower alkoxy, amino and carboxyl; heterocyclic of from 3 to 7 carbon atoms and 1 to 2 heteroatoms selected from oxygen, sulfur, and nitrogen; —C(O)R$^2$ where R$^2$ is selected from hydrogen, hydroxy, lower alkyl, lower alkoxy, and —NR$^3$R$^4$ where each of R$^3$ and R$^4$ is independently selected from hydrogen and lower alkyl; —S(O)$_n$R$^6$ where n is 1 or 2 and R$^6$ is C$_{1-6}$ alkyl, and with the proviso that R$^6$ does not define a side chain of a naturally occurring amino acid.

Examples of other synthetic amino acids include amino acids in which the amino group is separated from the carboxyl group by more than one carbon atom such as β-alanine and γ-aminobutyric acid.

Examples of suitable synthetic amino acids include the D-amino acids of naturally occurring L-amino acids, L-1-naphthyl-alanine, L-2-naphthylalanine, L-cyclohexylalanine, L-2-amino isobutyric acid, the sulfoxide and sulfone derivatives of methionine, such as HOOC—(H$_2$NCH) CH$_2$CH$_2$—S(O)$_n$R$^6$, where n and R$^6$ are as defined above as well as the lower alkoxy derivative of methionine, such as HOOC—(H$_2$NCH)CH$_2$CH$_2$OR$^6$ where R$^6$ is as defined above.

"N-terminus" refers to the end of a peptide or polypeptide, such as an N-terminus of an IL-7Rαγc ligand, an IL-7Rαγc ligand construct, an IL-7Rα ligand, or an Rγc ligand, that bears an amino group in contrast to the carboxyl end bearing a carboxyl acid group.

"C-terminus" refers to the end of a peptide or polypeptide, such as a C-terminus of an IL-7Rαγc ligand, an IL-7Rαγc ligand construct, an IL-7Rα ligand or an Rγc ligand, that bears a carboxylic acid group in contrast to the amino terminus bearing an amino group. In certain synthetic peptides, the N-terminus does not bear an amino group and/or the C-terminus does not bear a carboxyl group. In such cases the nomenclature refers to the direction of the peptide backbone.

"Pharmaceutically acceptable" refers to approved or approvable by a regulatory agency of the Federal or a state government or listed in the U.S. Pharmacopoeia or other generally recognized pharmacopoeia for use in animals, and more particularly in humans.

"Pharmaceutically acceptable salt" refers to a salt of a compound, which possesses a desired pharmacological activity of the parent compound. Such salts include acid addition salts, formed with inorganic acids and one or more protonate-able functional groups such as primary, secondary, or tertiary amines within the parent compound. Examples of inorganic acids include hydrochloric acid, hydrobromic acid, sulfuric acid, nitric acid, and phosphoric acid. A salt can be formed with organic acids such as, for example, acetic acid, propionic acid, hexanoic acid, cyclopentanepropionic acid, glycolic acid, pyruvic acid, lactic acid, malonic acid, succinic acid, malic acid, maleic acid, fumaric acid, tartaric acid, citric acid, benzoic acid, 3-(4-hydroxybenzoyl) benzoic acid, cinnamic acid, mandelic acid, methanesulfonic acid, ethanesulfonic acid, 1,2-ethane-disulfonic acid, 2-hydroxyethanesulfonic acid, benzenesulfonic acid, 4-chlorobenzenesulfonic acid, 2-naphthalenesulfonic acid, 4-toluenesulfonic acid, camphorsulfonic acid, 4-methylbicyclo [2.2.2]-oct-2-ene-1-carboxylic acid, glucoheptonic acid, 3-phenylpropionic acid, trimethylacetic acid, tertiary butylacetic acid, lauryl sulfuric acid, gluconic acid, glutamic acid, hydroxynaphthoic acid, salicylic acid, stearic acid, or muconic acid. A salt can be formed when one or more acidic protons present in the parent compound are replaced by a metal ion, e.g., an alkali metal ion, an alkaline earth ion, or an aluminum ion, or combinations thereof, or coordinates with an organic base such as ethanolamine, diethanolamine, triethanolamine, or N-methylglucamine. A pharmaceutically acceptable salt can be a hydrochloride salt. A pharmaceutically acceptable salt can be a sodium salt. A compound can have two or more ionizable groups, and a pharmaceutically acceptable salt can comprise one or more counterions, such as a bi-salt, for example, a dihydrochloride salt.

"Pharmaceutically acceptable salt" refers to hydrates and other solvates, as well as salts in crystalline or non-crystalline form. Where a particular pharmaceutically acceptable salt is disclosed, it is understood that the particular salt (e.g., a hydrochloride salt) is an example of a salt, and that other salts may be formed using techniques known to one of skill in the art. Additionally, a pharmaceutically acceptable salt to the corresponding compound, free base and/or free acid, using techniques generally known in the art. See also: Stahl and Wermuth, C. G. (Editors), Handbook of Pharmaceutical Salts, Wiley-VCH, Weinheim, Germany, 2008.

"Pharmaceutically acceptable vehicle" refers to a pharmaceutically acceptable diluent, a pharmaceutically acceptable adjuvant, a pharmaceutically acceptable excipient, a pharmaceutically acceptable carrier, or a combination of any of the foregoing with which a compound provided by the present disclosure may be administered to a patient and which does not destroy the pharmacological activity thereof and which is non-toxic when administered in doses sufficient to provide a therapeutically effective amount of the compound.

"Pharmaceutical composition" refers to a composition comprising an IL-7Rαγc binding compound provided by the present disclosure such as IL-7Rαγc ligands or a pharmaceutically acceptable salt thereof and IL-7Rαγc ligand constructs or a pharmaceutically acceptable salt thereof and at least one pharmaceutically acceptable vehicle with which the IL-7Rαγc binding compound or a pharmaceutically acceptable salt thereof is administered to a patient.

A "physiologically cleavable" or "hydrolyzable" or "degradable" bond is a bond that reacts with water (i.e., is hydrolyzed) under physiological conditions. The tendency of a bond to hydrolyze in water will depend not only on the general type of linkage connecting two central atoms but also on the substituents attached to these central atoms. Suitable hydrolytically unstable or weak linkages include, for example, carboxylate ester, phosphate ester, anhydrides, acetals, ketals, acyloxyalkyl ether, imines, orthoesters, peptides, and oligonucleotides.

"Preventing" or "prevention" refers to a reduction in risk of acquiring a disease or disorder (i.e., causing at least one of the clinical symptoms of the disease not to develop in a patient that may be exposed to or predisposed to the disease but does not yet experience or display symptoms of the disease). In some embodiments, "preventing" or "prevention" refers to reducing symptoms of the disease by taking the compound in a preventative fashion.

"Solvate" refers to a molecular complex of a compound with one or more solvent molecules in a stoichiometric or non-stoichiometric amount. Such solvent molecules are those commonly used in the pharmaceutical arts, which are known to be innocuous to a patient, e.g., water, ethanol, and the like. A molecular complex of a compound or moiety of a compound and a solvent can be stabilized by non-covalent intra-molecular forces such as, for example, electrostatic forces, van der Waals forces, or hydrogen bonds. The term "hydrate" refers to a solvate in which the one or more solvent molecules is water.

"Therapeutically effective amount" refers to the amount of a compound that, when administered to a patient for treating a disease, or at least one of the clinical symptoms of a disease, is sufficient to treat the disease or symptom thereof. A "therapeutically effective amount" may vary depending, for example, on the compound, the disease and/or symptoms of the disease, severity of the disease and/or symptoms of the disease or disorder, the age, weight, and/or health of the patient to be treated, and the judgment of a prescribing physician. An appropriate amount in any given instance may be ascertained by those skilled in the art or capable of determination by routine experimentation.

"Therapeutically effective dose" refers to a dose that provides effective treatment of a disease or disorder in a patient. A therapeutically effective dose may vary from compound to compound, and from patient to patient, and may depend upon factors such as the condition of the patient and the route of delivery. A therapeutically effective dose may be determined in accordance with routine pharmacological procedures known to those skilled in the art.

"Treating" or "treatment" of a disease refers to arresting or ameliorating a disease or at least one of the clinical symptoms of a disease or disorder, reducing the risk of acquiring a disease or at least one of the clinical symptoms of a disease, reducing the development of a disease or at least one of the clinical symptoms of the disease or reducing the risk of developing a disease or at least one of the clinical symptoms of a disease. "Treating" or "treatment" also refers to inhibiting the disease, either physically, (e.g., stabilization of a discernible symptom), physiologically, (e.g., stabilization of a physical parameter), or both, and to inhibiting at least one physical parameter or manifestation that may or may not be discernible to the patient. In certain embodiments, "treating" or "treatment" refers to delaying the onset of the disease or at least one or more symptoms thereof in a patient who may be exposed to or predisposed to a disease or disorder even though that patient does not yet experience or display symptoms of the disease.

"Tregs" or "Treg cells" refer to regulatory T-cells. Regulatory T-cells are a class of T-cells that suppress the activity of other immune cells and are defined using flow cytometry by the cell marker phenotypes CD4+/CD25+/FOXP3+, CD4+CD25+CD127lo, or CD4+/CD25+/FOXP3+/CD127lo. Because FOXP3 is an intracellular protein and requires cell fixation and permeabilization for staining, the cell surface phenotype CD4+CD25+CD127lo− can be used for defining live Tregs. Tregs also include various Treg subclasses, such as tTregs (thymus-derived) and pTregs (peripherally derived, differentiated from naive T-cells in the periphery). Tregs play a critical role in the induction and maintenance of peripheral self-tolerance to antigens, including those expressed by tumors.

"CD4+ T cells" are a type of lymphocyte that functions to coordinate the immune response by stimulating other immune cells such as macrophages, B lymphocytes (B cells), CD8 lymphocytes (CD8 cells) to fight infection. CD4+ T cells recognize peptides presented on MHC Class II molecules, which are found on antigen-presenting cells.

As with CD4+ T cells, "CD8+(cytotoxic) T-cells" are generated in the thymus and express the T-cell receptor. Cytotoxic T-cells express a dimeric co-receptor, CD8, which typically comprises one CD8a and one CD80 chain. CD8+ T-cells recognize peptides presented by MHC Class 1 molecules found on most nucleated cells. The CD8 heterodimer binds to a conservative portion of MHC Class 1 during T-cell/antigen presenting cell interactions. CD8+ T-cells (cytotoxic T lymphocytes, or CTLs) are important for immune defense against intracellular pathogens including viruses and bacteria, and for tumor surveillance.

"NK (natural killer) cells" are lymphocytes of the innate immune system and are classified as group I innate lymphocytes (ILCs). NK cells respond to a wide variety of pathological challenges including by killing virally infected cells and detecting and controlling early signs of cancer.

IL-7 mediates a variety of responses in lymphocytes and other immune cells types. Assays for such responses include stimulation of pSTAT5, cell proliferation or markers of proliferation such as Ki67, change in immune cell type ratios, and stimulation of the levels of effector proteins.

"Effector cells" refers to a population of lymphocytes that mediate the helper (CD4+ cells) and cytotoxic (CD8+ and NK cells) effects. Effector cells include effector T-cells such as CD4+ helper T-cells, CD8+ cytotoxic T-cells, NK cells, lymphokine-activated killer (LAK) cells and macrophages/monocytes.

"Naïve T-cells" refer to a T-cell that has differentiated in bone marrow and undergone the positive and negative processes of central selection in the thymus. Naïve T-cells include naïve forms of helper T cells, CD4+ T-cells) and naïve cytotoxic T-cells (CD8+ T-cells). Naïve T-cells are commonly characterized by the surface expression of L-selectin (CD62L) and C-C chemokine receptor type 7 (CCR7) and the expression of IL-7R (CD127) and the absence of the activation markers CD25, CD44, and CD69.

"Memory T-cells" are a subset of T lymphocytes including both CD4+ and CD8+. The primary function of memory cells is rapid augmented immune response after reactivation of those cells by reintroduction of a relevant antigen or pathogen into the body.

"Antigen binding moiety" refers to a polypeptide molecule that specifically binds to an antigenic determinant. An antigen binding moiety can direct, for example, the entity to which it is attached, such as a cytokine or a second antigen binding moiety, to a target site, for example, to a specific type of tumor cell or tumor stroma bearing the antigenic determinant. Antigen binding moieties include antibodies and fragments thereof. Examples of antigen binding moieties include an antigen binding domain of an antibody comprising an antibody heavy chain variable region and an antibody light chain variable region. An antigen binding moiety can include antibody constant regions. Useful heavy chain constant regions can include any of the five isotypes: α, δ, ε, γ, or μ. Useful light chain constant regions can include any of the two isotypes κ and λ.

"Polypeptide" refers to a molecule composed of monomers (amino acids) linearly linked by amide bonds (also known as peptide bonds). The term "polypeptide" refers to any chain of two or more amino acids and does not refer to a specific length of the product. Thus, peptides, dipeptides, tripeptides, oligopeptides, "protein," "amino acid chain," or any other term used to refer to a chain of two or more amino acids, are included within the definition of "polypeptide," and the term "polypeptide" may be used instead of, or interchangeably with any of these terms. The term "polypeptide" is also intended to refer to the products of post-expression modifications of the polypeptide including, for example, glycosylation, acetylation, phosphorylation, amidation, derivatization by known protecting/blocking groups, proteolytic cleavage, and/or modification by non-naturally occurring amino acids. A polypeptide may be derived from a natural biological source or produced by recombinant technology but is not necessarily translated from a designated nucleic acid sequence. A polypeptide may be generated in any manner, including by recombinant methods or by chemical synthesis. A polypeptide may have, for example, more than 100 amino acids, more than 200 amino acids, more than 500 amino acids, more than 1,000 amino acids, or more than 2,000 amino acids. Polypeptides may have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations and are referred to as unfolded.

"Polynucleotide" refers to an isolated nucleic acid molecule or construct, such as messenger RNA (mRNA), virally derived RNA, or plasmid DNA (pDNA). A polynucleotide may comprise a conventional phosphodiester bond or a non-conventional bond, such as an amide bond, such as found in peptide nucleic acids (PNA).

"Nucleic acid molecule" refers to any one or more nucleic acid segments, such as DNA or RNA fragments, present in a polynucleotide.

"Vector" or "expression vector" is synonymous with "expression construct" and refers to a DNA molecule that is used to introduce and direct the expression of a specific gene to which it is operably associated in a target cell. A vector can be a self-replicating nucleic acid structure as well as a vector incorporated into the genome of a host cell into which it has been introduced. An expression vector can comprise an expression cassette. Expression vectors allow transcription of large amounts of stable mRNA. Once an expression vector is inside the target cell, the ribonucleic acid molecule or protein that is encoded by the gene is produced by the cellular transcription and/or translation machinery. An expression vector can comprise an expression cassette that comprises polynucleotide sequences that encode an IL-7Rαγc ligand or IL-7Rαγc ligand construct provided by the present disclosure.

"Host cell," "host cell line," and "host cell culture" refer to cells into which are exogenous nucleic acid has been introduced, including the progeny of such cells. Host cells include, for example, "transformants" and "transformed cells," which include the primary transformed cell and progeny derived from the primary transformed cell without regard to the number of passages.

"Antibody" in the broadest sense encompasses various antibody structures including, for example, monoclonal antibodies, polyclonal antibodies, multi-specific antibodies such as bispecific antibodies, and antibody fragments that exhibit a desired antigen binding activity. The term "antibody" can be abbreviated as "ab" such as in the expression Fab or anti-phage Ab.

"Full-length antibody," "intact antibody," and "whole antibody" refer to an antibody having a structure substantially similar to a native antibody structure or having heavy chains that contain both Fab and an Fc region.

"Antibody fragment" refers to a molecule other than an intact antibody that comprises a portion of an intact antibody that binds the antigen to which the intact antibody binds. Examples of antibody fragments include Fv, Fab, Fab', Fab'-SH, F(ab')2, diabodies, linear antibodies, single-chain antibody molecules such as scFv, and multi-specific antibodies formed from antibody fragments. Diabodies are antibody fragments with two antigen binding sites that may be bivalent or bispecific. Antibody fragments can be made by various techniques, including but not limited to proteolytic digestion of an intact antibody as well as production by recombinant host cells such as *E. coli* or phage.

"Fab" or "Fab region" refers to a polypeptide that comprises the VH, CHI, VL, and CL immunoglobulin domains, generally on two different polypeptide chains such as VH-CHl on one chain and VL-CL on the other. Fab may refer to this region in isolation, or this region in the context of a bispecific antibody. In the context of a Fab, the Fab comprises an Fv region in addition to the CHI and CL domains.

"Fv" or "Fv fragment" or "Fv region" refers to a polypeptide that comprises the VL and VH domains of an antibody or "Fab". Fv regions can be formatted as both Fabs (generally two different polypeptides that also include the constant regions) and scFvs, where the vi and vh domains are combined (generally with a linker as discussed) to form an scFv.

"Single chain Fv" or "scFv" refers to a variable heavy domain covalently attached to a variable light domain, generally using a scFv linker as discussed herein, to form a scFv or scFv domain. A scFv domain can be in either orientation with the VL domain at the N- or C-terminus of the polypeptide, and conversely for the VH domain.

"Effector function" refers to a biochemical event that results from the interaction of an antibody Fc region with an Fc receptor or ligand. Effector functions include, for example, antibody-dependent cellular toxicity (ADCC), antibody-dependent cellular phagocytosis (ADCP), and complement-dependent cytotoxicity (CDC).

"Fc" or "Fc region" or "Fc chain" refers to polypeptide comprising the constant region of an antibody, in some instances, excluding all or a portion of the first constant region immunoglobulin domain (e.g., CHI) or a portion thereof, and in some cases, further excluding all or a portion of the hinge. Thus, an Fc can refer to the last two constant region immunoglobulin domains (e.g., CH2 and CH3) of IgA, IgD, and IgG, the last three constant region immunoglobulin domains of IgE and IgM, and optionally, all or a portion of the flexible hinge N-terminal to these domains. For IgA and IgM, Fc may include the J chain. For IgG, the Fc chain comprises immunoglobulin domains CH2 and CH3 (Cy2 and Cy3), and optionally all or a portion of the hinge region between CHI (Cy1) and CH2 (Cy2). Although the boundaries of the Fc region may vary, the human IgG heavy chain Fc region is usually defined to include residues E216, C226, or A231 to its carboxyl-terminus, wherein the numbering is according to the EU index as in Kabat. An amino acid modification can be made to the Fc region, for example to alter binding to one or more FcyR or to the FcRn. In EU numbering for human IgG1, the CH2-CH3 domain comprises amino acids 231 to 447, and the hinge is 216 to 230. Thus, the definition of Fc chain includes both amino acids 231-447 (CH2-CH3) or 216-447 (hinge-CH2-CH3), or fragments thereof. An Fc fragment can contain fewer amino acids from either or both of the N- and C-termini that retains the ability to form a dimer with another Fc chain or Fc fragment as can be detected using standard methods, generally based on size (e.g., non-denaturing chromatography, size exclusion chromatography, etc.). Human IgG Fc chains are of particular use, and can be the Fc chain from human IgG1, IgG2 or IgG4.

"Heavy constant region" refers to the CH1-hinge-CH2-CH3 portion of an antibody or fragments thereof, excluding the variable heavy domain; in EU numbering of human IgG1, such as amino acids 118-447. "Heavy chain constant region fragment" refers to a heavy chain constant region that contains fewer amino acids from either or both of the N- and C-termini that retains the ability to form a dimer with another heavy chain constant region.

"Immunoglobulin" refers to a protein having the structure of a naturally occurring antibody. For example, immunoglobulins of the IgG class are heterotetrameric glycoproteins of about 150,000 Da, composed of two light chains and two heavy chains that are bonded together through disulfide bonds. From N- to C-terminus, each heavy chain has a variable region (VH), also called a variable heavy domain or a heavy chain variable domain, followed by three constant domains (CHI, CH2, and CH3), also called a heavy chain constant region. Similarly, from N- to C-terminus, each light chain has a variable region (VL), also called a variable light domain or a light chain variable domain, followed by a constant light (CL) domain, also called a light chain constant region. The heavy chain of an immunoglobulin may be assigned to one of five classes, called α (IgA), δ (IgD), ε (IgE), γ (IgG), or μ(IgM), some of which may be further divided into subclasses, such as γ1 (IgG1), γ2 (IgG2), γ3 (IgG3), γ4(gG4), α1 (IgA1) and α2 (IgA2). The light chain of an immunoglobulin may be assigned to one of two types, kappa (κ) or lambda (λ), based on the amino acid sequence of its constant domain. An immunoglobulin essentially consists of two Fab molecules and an Fc chain, linked via the immunoglobulin hinge region.

"Immunoconjugate" refers to a polypeptide molecule that includes at least one IL-7Rαγc ligand and at least one antigen binding moiety. An immunoconjugate can comprise at least one IL-7Rαγc ligand, and at least two antigen binding moieties. An immunoconjugate can comprise at least one IL-7Rαγc ligand and two antigen binding moieties joined by one or more linker sequences. An antigen binding moiety can be joined to the IL-7Rαγc ligand by a variety of interactions and in a variety of configurations.

"Linker" refers to a moiety that binds one compound to another compound. Linkers can include IL-7Rαγc ligand linkers, tandem IL-7Rαγc ligand linkers, and IL-7Rαγc ligand construct linkers. A linker can be a synthetic linker. A linker can be an amino acid linker. In general, linkers provided by the present disclosure facilitate the ability of an IL-7Rαγc ligand to interact with IL-7R, to bind to IL-7R with high affinity, and/or to activate IL-7R. A linker can comprise a peptide or a non-peptide. Non-peptide linkers include those containing, for example, a triazole moiety derived from a Cu(I) catalyzed reaction of alkyne and azide functionalities. An IL-7Rαγc ligand linker refers to a moiety that binds at least one IL-7R ligand such as an IL-7Rα ligand and/or an Rγc ligand to another IL-7R ligand. A linker can bind to another IL-7R ligand which can be the same IL-7R ligand or a different IL-7R ligand. A linker can also bind to one or more additional moieties that provide a desired physiological function. A linker can be divalent or multivalent. A linker can be hydrolytically stable or may include a physiologically hydrolyzable or enzymatically degradable or cleavable linkage. A linker can bind IL-7R ligands to form dimers, trimers, or higher order multi-ligand peptides (heteromers) and compounds.

A ligand linker can be divalent or multivalent. A ligand linker can be hydrolytically stable or can include a physiologically hydrolyzable or enzymatically degradable ligand linkage. A ligand linker can bind IL-7Rα ligands to form dimers, trimers, or higher order multi-ligand peptides (heteromers) and compounds. A ligand linker can be a peptidyl ligand linker or a chemical ligand linker. An IL-7Rαγc ligand refers to a moiety comprising at least one IL-7Rα ligand and at least one Rγc ligand.

A "flexible linker" refers to a peptidyl linker comprising flexible amino acids such as glycine and serine. A flexible linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from glycine and serine. Examples of flexible linkers include (G). (SEQ ID NO: 9380), (GS)$_n$(SEQ ID NO: 9381), (GGS)$_n$(SEQ ID NO: 9382), (GGGS)$_n$(SEQ ID NO: 9383), or (GGGGS)$_n$ (SEQ ID NO: 9384) where n can be an integer from 1 to 20; (G)$_n$ (SEQ ID NO: 9385), (GS)$_n$ (SEQ ID NO: 9386), (GGS)$_n$ (SEQ ID NO: 9387), (GGGS)$_n$(SEQ ID NO: 9388), or (GGGGS)$_n$ (SEQ ID NO: 9389) where n can be an integer from 1 to 10; or (G)$_n$ (SEQ ID NO: 9390), (GS)$_n$ (SEQ ID NO: 9391), (GGS)$_n$ (SEQ ID NO: 9392), (GGGS)$_n$ (SEQ ID NO: 9393), or (GGGGS)$_n$ (SEQ ID NO: 9394) where n can be an integer from 1 to 5. (A flexible linker can have the amino acid sequence, for example, (GGGGS) (SEQ ID NO: 9395), (GGGGS)$_2$ (SEQ ID NO: 9396), (GGGGS)$_3$ (SEQ ID NO: 9397), (GGGGS)$_4$ (SEQ ID NO: 9398), (GG) (SEQ ID NO: 9399), (GGG) (SEQ ID NO: 9400), (GGGG) (SEQ ID NO: 9401), (GGS) (SEQ ID NO: 9402), (GGGS) (SEQ ID NO: 9403), (GGGGSGG) (SEQ ID NO: 9404), (GGS)$_2$ (SEQ ID NO: 9405), (G)$_5$ (SEQ ID NO: 9406), or (GS)$_{10}$ (SEQ ID NO: 9407).

A "rigid linker" refers to a peptidyl linker that is proline rich and can include other amino acids such as alanine, lysine, and/or glutamic acid. A rigid linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from proline, alanine, lysine, and glutamic acid. A rigid linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from proline and alanine. A rigid linker can have the sequence (P). (SEQ ID NO: 9420) or (PA)$_n$ (SEQ ID NO: 9421), where n is an integer from 1 to 20. A rigid linker can have the sequence (P)$_n$ (SEQ ID NO: 9422) or (PA)$_n$ (SEQ ID NO: 9423), where n is an integer from 1 to 10. A rigid linker can have the sequence (P)$_n$ (SEQ ID NO: 9424) or (PA), (SEQ ID NO: 9425), where n is an integer from 1 to 5. A rigid linker can have the sequence (PA)$_5$ (SEQ ID NO: 9426), (PA)$_7$ (SEQ ID NO: 9427). or (PA)$_{10}$ (SEQ ID NO: 9428).

"Protein" refers to at least two covalently attached amino acids, which includes proteins, polypeptides, oligopeptides and peptides. In addition, polypeptides that make up the antibodies may include synthetic derivatization of one or more side chains or termini, glycosylation, PEGylation, circular permutation, cyclization, linkers to other molecules, fusion to proteins or protein domains, and addition of peptide tags or labels. When a biologically functional molecule comprises two or more proteins, each protein may be referred to as a "monomer" or as a "subunit" or as a "domain"; and the biologically functional molecule may be referred to as a "complex".

"Amino acid sequence similarity" refers to an amino acid sequence in which one or more amino acids of the sequence has been replaced with a chemically similar amino acid. Examples of chemically similar amino acids include (a) amino acids having a small hydrophobic side chain such as alanine (A), glycine (G), proline (P), serine (S), or threonine (T); (b) amino acids having a hydroxyl-containing side chain such as serine (S), threonine (T), or tyrosine (Y); (c) amino acids having an acidic side chain such as aspartate (D) or glutamate (E); (d) amino acids having a polar-neutral side chain such as histidine (H), asparagine (N), glutamine (Q), serine (S), threonine (T), or tyrosine (Y); (e) amino acids having a basic side chain such as arginine (R), lysine (K), or histidine (H); (f) amino acids having a large hydrophobic side chain such as isoleucine (I), leucine (L), methionine (M), valine (V), phenylalanine (F), tyrosine (Y), or tryptophan (W); and (g) amino acids having an aromatic side chain comprising phenylalanine (F), histidine (H), tryptophan (W), or tyrosine (Y). A chemically similar amino acid can comprise a naturally occurring amino acid or a non-natural amino acid.

"Percent (%) sequence similarity" is determined by comparing the number of amino acids that are the same in a subject binding compound and a reference binding compound. A binding compound provided by the present disclosure can comprise, for example, greater than 70%, greater than 80%, or greater than 90% sequence similarity to a reference binding compound. For example, based on a reference binding compound having SEQ ID NO: 1130, binding compounds having SEQ-ID NOS: 1131-1136, have either 1, 2, 3, 4, or 5 amino acid in which an amino acid of the reference peptide has been substituted or replaced with the amino acid, alanine. Binding compounds having SEQ ID NOS: 1131-1136 are characterized by a 95%, 90%, 85%, 80%, 75%, or 70% sequence similarity, respectively, to the amino acid sequence of the reference peptide.

```
                                           SEQ ID NO: 1130
    Y P C W L A R V G E L C D L D S G D V H

SEQ ID NO: 1131
    A P C W L A R V G E L C D L D S G D V H

SEQ ID NO: 1132
    A P C A L A R V G E L C D L D S G D V H

SEQ ID NO: 1133
    A P C A L A A V G E L C D L D S G D V H

SEQ ID NO: 1134
    A P C A L A A V G A L C D L D S G D V H

SEQ ID NO: 1135
    A P C A L A A V G A L C D L A S G D V H

SEQ ID NO: 1136
    A P C A L A A V G A L C D L A A G D V H
```

A binding compound provided by the present disclosure can have an amino acid sequence in which from 1 to 5 amino acids of a reference amino acid sequence is substituted with another amino acid.

For example, a binding compound derived from a reference binding compound can have from 1 to 5 amino acid substitutions, from 1 to 4, from 1 to 3, or from 1 to 2 amino acid substitutions. For example, a binding compound derived from a reference binding compound can have 1 amino acid substitution, 2 amino acid substitutions, 3 amino acid substitutions, 4 amino acid substitutions, or 5 amino acid substitutions.

An amino acid substitution can be independent of the other amino acid substitutions.

Each amino acid substitution can independently be a conservative amino acid substitution or a non-conservative amino acid substitution.

A conservative amino acid substitution refers to one of the following amino acid substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

For example, a reference binding compound can have the amino acid sequence of SEQ ID NO: 1120.

```
                                          SEQ ID NO: 1120
    Y W C W M A Q V G E L C D L

SEQ ID NO: 1121
    Y H C W M A Q V G E L C D L

SEQ ID NO: 1122
    Y H C W M G Q V G E L C D L

SEQ ID NO: 1123
    Y H C W M G Q M G E L C D L

SEQ ID NO: 1124
    Y H C W M G Q M G E L C E L

SEQ ID NO: 1125
    Y H C W M G Q M G E L C E M
```

Binding compounds having SEQ ID NOS: 1121-1125 represent binding compounds in which the reference binding compound having SEQ ID NO: 1120 has been substituted with from 1 to 5 conservative amino acid substitutions, respectively.

A binding compound provided by the present disclosure can comprise a truncated binding compound. A truncated binding compound refers to a binding compound in which from 1 to 5 amino acids have independently been removed from the N-terminus, the C-terminus, or from both the N-terminus and the C-terminus of the corresponding reference binding compound. A truncated binding compound derived from the corresponding reference binding compound can independently have from 1 to 5 amino acids, such as from 1 to 4 amino acids, from 1 to 3 amino acids, or from 1 to 2 amino acids independently removed from the N-terminus, the C-terminus, or from both the N-terminus and the C-terminus of the reference binding compound. A truncated binding compound derived from the corresponding reference binding compound can independently have 1 amino acid, 2 amino acids, 3 amino acids, 4 amino acids, or 5 amino acids removed from the N-terminus, the C-terminus, or from both the N-terminus and the C-terminus of the reference binding compound.

For example, a reference binding compound can have the amino acid sequence of SEQ ID NO: 1100. Examples of truncated binding compounds derived from the reference binding compound of SEQ ID NO: 1100 include truncated binding compounds of amino acid sequence of SEQ ID NOS: 1101-1108.

```
                                          SEQ ID NO: 1100
    M G F Y P C W T A Q L G E L C D L S V D

SEQ ID NO: 1101
      G F Y P C W T A Q L G E L C D L S V D

SEQ ID NO: 1102
        F Y P C W T A Q L G E L C D L S V D

SEQ ID NO: 1103
          Y P C W T A Q L G E L C D L S V D

SEQ ID NO: 1104
    M G F Y P C W T A Q L G E L C D L S V

SEQ ID NO: 1105
    M G F Y P C W T A Q L G E L C D L S

SEQ ID NO: 1106
    M G F Y P C W T A Q L G E L C D L

SEQ ID NO: 1107
      G F Y P C W T A Q L G E L C D L S V

SEQ ID NO: 1108
        F Y P C W T A Q L G E L C D L
```

The truncated binding compounds of SEQ ID NOS: 1101-1103 have amino acids removed from the N-terminus of the reference binding compound; truncated binding compounds of SEQ ID NOS: 1104-1106 have amino acids removed from the C-terminus of the reference binding compound; and truncated binding compounds of SEQ ID NOS: 1107-1108 have amino acids removed from both the N-terminus and from the C-terminus of the reference binding compound.

As another example, a reference binding compound can comprise an amino acid sequence of Formula (A):

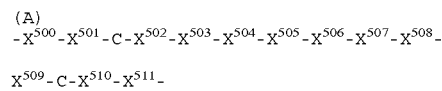

where each —X— independently represents an amino acid. Amino acid sequences of Formula (A1)-(A5) represent truncated binding compounds derived from the reference binding compound comprising the amino acid sequence of Formula (A):

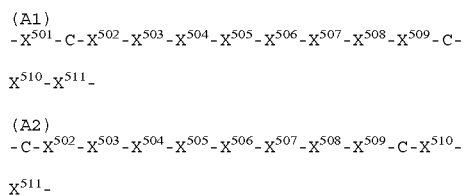

-continued (A3)
-C-X$^{502}$-X$^{503}$-X$^{504}$-X$^{505}$-X$^{506}$-X$^{507}$-X$^{508}$-X$^{509}$-C-

(A4)
-X$^{502}$-X$^{503}$-X$^{504}$-X$^{505}$-X$^{506}$-X$^{507}$-X$^{508}$-X$^{509}$-C-X$^{510}$-

(A5)
-X$^{502}$-X$^{503}$-X$^{504}$-X$^{505}$-X$^{506}$-X$^{507}$-X$^{508}$-X$^{509}$-

A binding compound provided by the present disclosure can comprise an amino acid sequence in which from 1 to 3 glycines are independently bonded to the N-terminus, to the C-terminus, or to both the N-terminus and to the C-terminus of a reference binding compound.

For example, reference binding compound can have SEQ ID NO: 1110. Binding compounds having SEQ ID NOS: 1111-1113 have from 1 to 3 glycines bonded to the N-terminus of the reference binding compound, respectively; binding compounds having SEQ ID NOS: 1114-1116 have from 1 to 3 glycines bonded to the C-terminus of the reference binding compound, respectively; and binding compounds having SEQ ID NOS: 1117-1118 independently have 1 or 2 glycines (SEQ ID NO: 9399) bonded to both the N-terminus and to the C-terminus of the reference binding compound.

```
                                        SEQ ID NO: 1110
    K Y C G F A Q L G E L C V L

SEQ ID NO: 1111
  G K Y C G F A Q L G E L C V L

SEQ ID NO: 1112
G G K Y C G F A Q L G E L C V L

SEQ ID NO: 1113
G G G K Y C G F A Q L G E L C V L

SEQ ID NO: 1114
    K Y C G F A Q L G E L C V L G

SEQ ID NO: 1115
    K Y C G F A Q L G E L C V L G G

SEQ ID NO: 1116
    K Y C G F A Q L G E L C V L G G G

SEQ ID NO: 1117
  G K Y C G F A Q L G E L C V L G

SEQ ID NO: 1118
G G K Y C G F A Q L G E L C V L G
```

A binding compound can comprise a truncated binding compound in which from 1 to 3 glycines are independently bonded to the N-terminus, to the C-terminus, or to both the N-terminus and to the C-terminus of a reference truncated binding compound.

"IL-7Rα binding compound" refers to an IL-7Rαγc ligand provided by the present disclosure, a tandem IL-7Rαγc ligand provided by the present disclosure, an IL-7Rαγc ligand construct provided by the present disclosure, and a construct comprising at least one IL-7Rα ligand and at least one Rγc ligand provided by the present disclosure.

"IL-7R", "IL-7Rα subunit", and "Rγc subunit" refer to a mammalian "IL-7R", "IL-7Rα subunit", and "Rγc subunit" respectively, such as the human IL-7R, the human IL-7Rα subunit, and the Rγc subunit, respectively.

A recombinant "IL-7Rαγc ligand fusion protein" refers to a protein made by recombinant DNA technology in which the translational reading frame of an IL-7Rαγc ligand is fused to that of another protein, i.e., the IL-7Rαγc ligand fusion partner, to produce a single recombinant polypeptide. An IL-7Rαγc ligand fusion protein can comprise one or more IL-7Rα ligands and one or more Rγc ligands. An IL-7Rαγc ligand-fusion partner can comprise the Fc domain of an IgG molecule where the IL-7Rαγc ligand is attached to one or both C-termini of the Fc structures. An IL-7Rαγc ligand-fusion protein can include a peptidyl linker such as an amino acid sequence coupling the IL-7Rαγc ligand to the fusion protein partner, such that the peptidyl linker amino acid sequence is not derived from either the IL-7Rαγc ligand or the fusion protein partner. Such linkers are referred to as construct linkers. Construct linkers can be incorporated into fusion proteins as spacers to promote proper protein folding and stability of the component protein moieties, to improve protein expression, and/or to enable better bioactivity of the two fusion partners. Construct linkers can include, for example, flexible peptides and/or rigid peptides. A construct linker can be a chemical construct linker.

The expression "at least one" refers to "one or more." For example, the expression "at least" can refer to from 1 to 10, from 1 to 8, from 1 to 6, from 1 to 5, from 1 to 4, from 1 to 3, or from 1 to 2. For example, the expression "at least one" can refer to 1, 2, 3, 4, 5, 6, 7, 8, 9, or 10.

Reference is now made in detail to certain embodiments of compounds, compositions, and methods. The disclosed embodiments are not intended to be limiting of the claims. To the contrary, the claims are intended to cover all alternatives, modifications, and equivalents.

The present disclosure is directed to IL-7Rαγc binding compounds including IL-7Rαγc ligands, tandem IL-7Rαγc ligands, and IL-7Rαγc ligand constructs. The IL-7Rαγc binding compounds can be IL-7R agonists, partial agonists, or antagonists.

IL-7Rαγc ligands provided by the present disclosure comprise an IL-7Rα ligand, an Rγc ligand, and an IL-7Rαγc ligand linker coupling the IL-7Rα and Rγc ligands. An IL-7Rαγc ligand can be an IL-7R agonist, a partial IL-7R agonist, or an IL-7R antagonist.

Tandem IL-7Rαγc ligands provided by the present disclosure comprise two or more IL-7Rαγc ligands coupled together by one or more tandem linkers.

IL-7Rαγc constructs provided by the present disclosure can comprise at least one IL-7Rαγc ligand coupled to another molecule referred to as a construct partner such as a polymer, protein, Fc-fragment, immunoglobulin fragment, or antibody. An IL-7Rαγc construct provided by the present disclosure can also comprise at least one IL-7Rα ligand and at least one Rγc ligand.

IL-7Rαγc binding compounds provided by the present disclosure include compounds capable of binding to a unique binding site on the IL-7Rα subunit and/or the Rγc subunit and bind to the unique binding site with an IC$_{50}$ of less than 100 μM, less than 10 μM, less than 1 μM, less than 100 nM, or less than 10 nM.

An IL-7Rαγc binding compound can comprise at least one IL-7Rα ligand. Examples of suitable IL-7Rα ligands are disclosed in U.S. Provisional Application No. 62/969,432, filed on Feb. 3, 2020, entitled IL-7R-Alpha Binding Compounds, which is incorporated by reference in its entirety.

An IL-7Rα ligand provided by the present disclosure can bind to the human IL-7Rα subunit with an IC$_{50}$ of less than 100 μM, less than 10 μM, less than 1 μM, less than 0.1 μM, or less than 0.01 μM.

An IL-7Rα ligand can bind to the human IL-7Rα subunit with an $IC_{50}$ from 1 pM to 100 μM, from 10 μM to 10 μM, from 100 pM to 1 μM, from 0.001 μM to 1 μM, or from 0.01 μM to 1 μM.

An IL-7Rα ligand provided by the present disclosure can bind to a mammalian IL-7Rα subunit with an $IC_{50}$ of less than 100 μM, less than 10 μM, less than 1 μM, less than 0.1 μM, or less than 0.01 μM.

An IL-7Rα ligand can bind to a mammalian IL-7Rα subunit with an $IC_{50}$ from 1 pM to 100 μM, from 10 μM to 10 μM, from 100 pM to 1 μM, from 0.001 μM to 1 μM, or from 0.01 μM to 1 μM.

An IL-7Rα ligand provided by the present disclosure can bind to the human IL-7Rα subunit and to the human Rγc subunit with an $IC_{50}$ of less than 100 μM, less than 10 μM, less than 1 μM, less than 0.1 μM, or less than 0.01 μM.

An IL-7Rα ligand provided by the present disclosure can comprise an amino acid sequence of Formula (1) (SEQ ID NO: 9434), an amino acid sequence of Formula (1a) (SEQ ID NO: 9435), an amino acid sequence of Formula (1b) (SEQ ID NO: 9436), or an amino acid sequence of Formula (1c) (SEQ ID NO: 9437):

(1)
$-X^{201}-X^{202}-X^{203}-X^{204}-X^{205}-X^{206}-X^{207}-X^{208}-X^{209}-$
$X^{210}-X^{211}-X^{212}-X^{213}-X^{214}-X^{215}-X^{216}-$ (1a)
$-X^{202}-X^{203}-X^{204}-X^{205}-X^{206}-X^{207}-X^{208}-X^{209}-X^{210}-$
$X^{211}-X^{212}-X^{213}-X^{214}-X^{215}-$ (1b)
$-X^{203}-X^{204}-X^{205}-X^{206}-X^{207}-X^{208}-X^{209}-X^{210}-X^{211}-$
$X^{212}-X^{213}-X^{214}-$ (1c)
$-X^{204}-X^{205}-X^{206}-X^{207}-X^{208}-X^{209}-X^{210}-X^{211}-X^{212}-$
$X^{213}-$ wherein,
$X^{201}$ can be selected from an amino acid comprising a large hydrophobic side chain;
$X^{202}$ can be selected from an amino acid comprising a small hydrophobic side chain or cysteine;
$X^{203}$ can be selected from an amino acid comprising a large hydrophobic side chain;
$X^{204}$ can be selected from an amino acid comprising a basic side chain or cysteine;
$X^{205}$ can be selected from an amino acid comprising a large hydrophobic side chain or an amino acid comprising small hydrophobic side chain;
$X^{206}$ can be selected from an amino acid comprising a large hydrophobic side chain or an amino acid comprising an acidic side chain;
$X^{207}$ can be selected from an amino acid comprising an acidic side chain;
$X^{208}$ can be selected from an amino acid comprising an acidic side chain or an amino acid comprising a small hydrophobic side chain;
$X^{209}$ can be selected from an amino acid comprising a small hydrophobic side chain;
$X^{210}$ can be selected from an amino acid comprising a large hydrophobic side chain or an amino acid comprising a small hydrophobic side chain;
$X^{211}$ can be selected from an amino acid comprising a large hydrophobic side chain;
$X^{212}$ can be selected from an amino acid comprising a polar/neutral side chain;
$X^{213}$ can be selected from cysteine;
$X^{214}$ can be selected from an amino acid comprising a small hydrophobic side chain or an amino acid comprising a large hydrophobic side chain;
$X^{215}$ can be selected from an amino acid comprising a large hydrophobic side chain; and
$X^{216}$ can be selected from an amino acid comprising a large hydrophobic side chain.

In IL-7Rα ligands of Formula (1)-(1c), $X^{201}$ can be selected from H, I, Q, and V.
In IL-7Rα ligands of Formula (1)-(1c), $X^{201}$ can be selected from I, Q, and V.
In IL-7Rα ligands of Formula (1)-(1c), $X^{201}$ can be I.
In IL-7Rα ligands of Formula (1)-(1c), $X^{202}$ can be selected from C, P, and R.
In IL-7Rα ligands of Formula (1)-(1c), $X^{202}$ can be selected from C and P.
In IL-7Rα ligands of Formula (1)-(1c), $X^{203}$ can be selected from I, K, L, S, V, and W.
In IL-7Rα ligands of Formula (1)-(1c), $X^{203}$ can be W.
In IL-7Rα ligands of Formula (1)-(1c), $X^{204}$ can be selected from C and H.
In IL-7Rα ligands of Formula (1)-(1c), $X^{204}$ can be C.
In IL-7Rα ligands of Formula (1)-(1c), $X^{205}$ can be selected from A, I, L, M, T, and W.
In IL-7Rα ligands of Formula (1)-(1c), $X^{205}$ can be selected from T and W.
In IL-7Rα ligands of Formula (1)-(1c), $X^{206}$ can be selected from D, L, and W.
In IL-7Rα ligands of Formula (1)-(1c), $X^{206}$ can be selected from D and L.
In IL-7Rα ligands of Formula (1)-(1c), $X^{207}$ can be selected from D, I, L, and Q.
In IL-7Rα ligands of Formula (1)-(1c), $X^{207}$ can be selected from D and L.
In IL-7Rα ligands of Formula (1)-(1c), $X^{207}$ can be D.
In IL-7Rα ligands of Formula (1)-(1c), $X^{208}$ can be selected from D, E, and P.
In IL-7Rα ligands of Formula (1)-(1c), $X^{208}$ can be selected from E and P.
In IL-7Rα ligands of Formula (1)-(1c), $X^{208}$ can be P.
In IL-7Rα ligands of Formula (1)-(1c), $X^{209}$ can be selected from G, S, and T.
In IL-7Rα ligands of Formula (1)-(1c), $X^{209}$ can be selected from G and S.
In IL-7Rα ligands of Formula (1)-(1c), $X^{209}$ can be G.
In IL-7Rα ligands of Formula (1)-(1c), $X^{210}$ can be selected from A, G, L, and S.
In IL-7Rα ligands of Formula (1)-(1c), $X^{210}$ can be selected from L and S.
In IL-7Rα ligands of Formula (1)-(1c), $X^{211}$ can be selected from F, I, L, and M.
In IL-7Rα ligands of Formula (1)-(1c), $X^{211}$ can be L.
In IL-7Rα ligands of Formula (1)-(1c), $X^{212}$ can be selected from G, H, L, N, Q, and S.
In IL-7Rα ligands of Formula (1)-(1c), $X^{212}$ can be selected from Q and S.
In IL-7Rα ligands of Formula (1)-(1c), $X^{212}$ can be Q.
In IL-7Rα ligands of Formula (1)-(1c), $X^{213}$ can be C.
In IL-7Rα ligands of Formula (1)-(1c), $X^{214}$ can be selected from A, E, I, L, S, T, and V.
In IL-7Rα ligands of Formula (1)-(1c), $X^{214}$ can be selected from A and V.
In IL-7Rα ligands of Formula (1)-(1c), $X^{215}$ can be selected from F, R, W, and Y.

In IL-7Rα ligands of Formula (1)-(1c), $X^{215}$ can be W.

In IL-7Rα ligands of Formula (1)-(1c), $X^{216}$ can be selected from E, L, Q, and W.

In IL-7Rα ligands of Formula (1)-(1c), $X^{216}$ can be L.

In IL-7Rα ligands of Formula (1)-(1c), the IL-7Rα ligand can be defined by any combination of $X^{201}$—$X^{26}$ as defined in the immediately preceding thirty-five (35) paragraphs.

In IL-7Rα ligands of Formula (1)-(1c),
$X^{201}$ can be selected from H, I, Q, and V;
$X^{202}$ can be selected from C, P, and R;
$X^{203}$ can be selected from I, K, L, S, V, and W;
$X^{204}$ can be selected from C and H;
$X^{205}$ can be selected from A, I, L, M, T, and W;
$X^{206}$ can be selected from D, L, and W;
$X^{207}$ can be selected from D, I, L, and Q;
$X^{208}$ can be selected from D, E, and P;
$X^{209}$ can be selected from G, S, and T;
$X^{210}$ can be selected from A, G, L, and S;
$X^{211}$ can be selected from F, I, L, and M;
$X^{212}$ can be selected from G, H, L, N, Q, and S;
$X^{213}$ can be C;
$X^{214}$ can be selected from A, E, I, L, S, T, and V;
$X^{215}$ can be selected from F, R, W, and Y; and
$X^{216}$ can be selected from E, L, Q, and W.

In IL-7Rα ligands of Formula (1)-(1c),
$X^{201}$ can be selected from I, Q, and V;
$X^{202}$ can be selected from C and P;
$X^{203}$ can be W;
$X^{204}$ can be selected from C and H;
$X^{205}$ can be selected from T and W;
$X^{206}$ can be selected from D and L;
$X^{207}$ can be selected from D and L;
$X^{208}$ can be selected from E and P;
$X^{209}$ can be selected from G and S;
$X^{210}$ can be selected from L and S;
$X^{211}$ can be L;
$X^{212}$ can be selected from Q and S;
$X^{213}$ can be C;
$X^{214}$ can be selected from A and V; and
$X^{215}$ can be W; and
$X^{216}$ can be L.

In IL-7Rα ligands of Formula (1)-(1c),
$X^{201}$ can be I;
$X^{202}$ can be selected from C and P;
$X^{203}$ can be W;
$X^{204}$ can be selected from C and H;
$X^{205}$ can be selected from T and W;
$X^{206}$ can be selected from D and L;
$X^{207}$ can be D;
$X^{208}$ can be P;
$X^{209}$ can be G;
$X^{210}$ can be selected from L and S;
$X^{211}$ can be L;
$X^{212}$ can be Q;
$X^{213}$ can be C;
$X^{214}$ can be selected from A and V;
$X^{215}$ can be W; and
$X^{216}$ can be L.

In IL-7Rα ligands of Formula (1)-(1c),
$X^{201}$ can be Q;
$X^{202}$ can be C;
$X^{203}$ can be selected from I, L, K, and V;
$X^{204}$ can be H;
$X^{205}$ can be W;
$X^{206}$ can be D;
$X^{207}$ can be selected from I and L;
$X^{208}$ can be E;
$X^{209}$ can be selected from S and T;
$X^{210}$ can be L;
$X^{211}$ can be L;
$X^{212}$ can be selected from G, L, N, and S;
$X^{213}$ can be C;
$X^{214}$ can be selected from I, L, and V;
$X^{215}$ can be R; and
$X^{216}$ can be E.

In IL-7Rα ligands of Formula (1)-(1c),
$X^{201}$ can be selected from I and V;
$X^{202}$ can be P;
$X^{203}$ can be W;
$X^{204}$ can be C;
$X^{205}$ can be T;
$X^{206}$ can be L;
$X^{207}$ can be D;
$X^{208}$ can be P;
$X^{209}$ can be G;
$X^{210}$ can be selected from L and S;
$X^{211}$ can be L;
$X^{212}$ can be Q;
$X^{213}$ can be C;
$X^{214}$ can be A;
$X^{215}$ can be selected from W; and
$X^{216}$ can be L.

An IL-7Rα ligand can comprise an amino acid sequence or a truncated amino acid sequence selected from any one of SEQ ID NO: 393 to SEQ ID NO: 410:

```
                                            SEQ ID NO: 393
H C L H W N I E T L M S C V Y G N F E E

SEQ ID NO: 394
H C K H W D L E S L L L C V

SEQ ID NO: 395
H L G V P W C T L D P G S I Q C A W L A K H

SEQ ID NO: 396
I R S C L W Q P G A L H C T W W A E E E P V

SEQ ID NO: 397
I P W C L L D P G G L Q C V W L

SEQ ID NO: 398
K A G S W F I P W C T L D P G S L Q C A F L

SEQ ID NO: 399
N P F R S V V P W C A L D P G S L Q C A W L

SEQ ID NO: 400
Q C I H W D I E T L L S C V

SEQ ID NO: 401
Q C I H W D L E S L L N C L R E L K E P

SEQ ID NO: 402
Q C V H W D L D T L F G C I R E Q L E L

SEQ ID NO: 403
R H F D D I I P W C T L D P G S L Q C A Y L

SEQ ID NO: 404
S A K V L K Q C L H W D L E S L L S C L

SEQ ID NO: 405
S L T V P W C T L D P G S M Q C A W L Q N R

SEQ ID NO: 406
V P W C M L D P G S M Q C A W L

SEQ ID NO: 407
V H R I P W C T L D P G G L Q C A W L R Q M
```

-continued

```
                                          SEQ ID NO: 408
W V T I P W C I L D P G S L Q C E W Q T K V

SEQ ID NO: 409
G W G I P W C T L D P G S L Q C A W L G K H

SEQ ID NO: 410
Y R S G H G I P W C M L D P G G L Q C S W L
```

An IL-7Rα ligand provided by the present disclosure can comprise a truncated amino acid sequence of any one of SEQ ID NOS: 389-410 and 9434-9437.

An IL-7Rα ligand provided by the present disclosure can comprise an amino acid sequence selected from any one of SEQ ID NOS: 389-410 and 9434-9437, or a truncated amino acid sequence of any one SEQ ID NOS: 389-410 and 9434-9437, wherein the amino acid sequence can independently comprise from 1 to 5 glycines (G) (SEQ ID NO: 9390) on the N-terminus, on the C-terminus, or on both the N- and C-termini.

An IL-7Rα ligand provided by the present disclosure can comprise an amino acid sequence selected from any one of SEQ ID NOS: 389-410 and 9434-9437, or a truncated amino acid sequence of any one of SEQ ID NOS: 389-410 and 9434-9437, wherein the amino acid sequence comprises one or more amino acid substitutions such as from 1 to 5 amino acid substitutions. The amino acid substitutes can comprise conservative amino acid substitutions.

An IL-7Rα ligand can comprise an amino acid sequence or a truncated amino acid sequence similarity greater than 60%, greater than 70%, greater than 75%, greater than 80%, greater than 85%, greater than 90%, or greater than 95% to the amino acid sequence of any one of SEQ ID NOS: 389-410 and 9434-9437.

An IL-7Rα ligand of any one of SEQ ID NOS: 389-410 and 9434-9437 bound to the hIL-7Rα subunit with an $IC_{50}$ of less than 10 μM as determined using phage ELISA competition assays.

Certain IL-7Rα ligands provided by the present disclosure can bind to a unique binding site on the IL-7Rα subunit that is different from the binding site on the IL-7Rα subunit to which IL-7 binds.

IL-7Rα ligands having SEQ ID NOS: 5, 43, 104, 146, and 313 do not bind competitively with IL-7 binding to IL-7Rα, indicating that the IL-7Rα ligand binding site for these compounds is distinct from that of IL-7. This group of IL-7Rα ligands bind to a unique binding site on the IL-7Rα subunit with an $IC_{50}$ of less than 10 μM.

A unique binding site on the IL-7Rα subunit can be characterized by at least the following properties: (1) a group of IL-7Rα ligands bind to each unique binding site on the IL-7Rα subunit with an $IC_{50}$ of less than 10 μM; (2) each of the IL-7Rα ligands within the group competitively bind to the unique binding site on the IL-7Rα subunit with each of the other IL-7Rα ligands within the group; (3) a peptide having the amino acid sequence of SEQ ID NO: 965 does not compete for binding to a unique binding site on the IL-7Rα subunit with the peptides within the group of IL-7Rα ligands; and (4) IL-7Rα ligands having SEQ ID NOS: 5, 43, 104, 146, and 313 do not bind competitively with IL-7 binding to IL-7Rα, indicating that this IL-7Rα ligand binding site is distinct from that of IL-7.

The group of IL-7Rα ligands comprises at least the IL-7Rα ligands having the amino acid sequence of any one of SEQ ID NOS: 5, 43, 104, 146, and 313.

The unique binding site of the IL-7Rα subunit for these IL-7Rα ligands can be characterized using competitive binding assays as described, for example, in Example 12.

An IL-7Rα ligand can comprise an amino acid sequence selected from any one of SEQ ID NO: 420 to SEQ ID NO: 486:

```
                                          SEQ ID NO: 420
I P W C T L D P G G L Q C A W L R Q M

SEQ ID NO: 421
I P W C T L D P G G L Q C A A L R Q M

SEQ ID NO: 422
I P W C T L D P G G L Q C A F L R Q M

SEQ ID NO: 423
I P W C T L D P G G L Q C A Y L R Q M

SEQ ID NO: 424
I P W C T L D P G G L Q C A H L R Q M

SEQ ID NO: 425
I P W C T L D P G G L Q C A W A R Q M

SEQ ID NO: 426
I P W C T L D P G G L Q C A W I R Q M

SEQ ID NO: 427
I P W C T L D P G G L Q C A W V R Q M

SEQ ID NO: 428
I P W C T L D P G G L Q C A W L A Q M

SEQ ID NO: 429
I P W C T L D P G G L Q C A W L K Q M

SEQ ID NO: 430
I P W C T L D P G G L Q C A W H K Q M

SEQ ID NO: 431
I P W C T L D P G G L Q C A W L R A M

SEQ ID NO: 432
I P W C T L D P G G L Q C A W L R Q A

SEQ ID NO: 433
I P W C T L D P G G L Q C A W L R A A

SEQ ID NO: 434
I P W C T L D P G G L Q C A W L A A A

SEQ ID NO: 420
    I P W C T L D P G G L Q C A W L R Q M

SEQ ID NO: 435
    I P W C T L D P G G L Q C A W L R Q

SEQ ID NO: 436
    I P W C T L D P G G L Q C A W L R

SEQ ID NO: 437
    I P W C T L D P G G L Q C A W L

SEQ ID NO: 438
    I P W C T L D P G G L Q C A W

SEQ ID NO: 439
    I P W C T L D P G G L Q C A W L R Q M G G

SEQ ID NO: 440
    I P W C T L D P G G L Q C A W L R Q G G

SEQ ID NO: 441
    I P W C T L D P G G L Q C A W L R G G

SEQ ID NO: 442
    I P W C T L D P G G L Q C A W L G G

SEQ ID NO: 443
    I P W C T L D P G G L Q C A W G G
```

```
GGIPWCTLDPGGLQCAWLRQM                    SEQ ID NO: 444
GGIPWCTLDPGGLQCAWLRQ                     SEQ ID NO: 445
GGIPWCTLDPGGLQCAWLR                      SEQ ID NO: 446
GGIPWCTLDPGGLQCAWL                       SEQ ID NO: 447
GGIPWCTLDPGGLQCAW                        SEQ ID NO: 448
GGIPWCTLDPGGLQCAWLRQMGG                  SEQ ID NO: 449
GGIPWCTLDPGGLQCAWLRQGG                   SEQ ID NO: 450
GGIPWCTLDPGGLQCAWLRGG                    SEQ ID NO: 451
GGIPWCTLDPGGLQCAWLGG                     SEQ ID NO: 452
GGIPWCTLDPGGLQCAWGG                      SEQ ID NO: 453
VHRIPWCTLDPGGLQCAWLRQM                   SEQ ID NO: 407
VHRIPWCTLDPGGLQCAWLRQMGG                 SEQ ID NO: 454
GGVHRIPWCTLDPGGLQCAWLRQM                 SEQ ID NO: 455
GGVHRIPWCTLDPGGLQCAWLRQMGG               SEQ ID NO: 456
VHRIPWCTLDPGGLQCAWLRQ                    SEQ ID NO: 457
VHRIPWCTLDPGGLQCAWLR                     SEQ ID NO: 458
VHRIPWCTLDPGGLQCAWLRM                    SEQ ID NO: 459
GGVHRIPWCTLDPGGLQCAWLRQ                  SEQ ID NO: 460
GGVHRIPWCTLDPGGLQCAWLR                   SEQ ID NO: 461
GGVHRIPWCTLDPGGLQCAWLRM                  SEQ ID NO: 462
VHRIPWCTLDPGGLQCAWARQM                   SEQ ID NO: 463
VHRIPWCTLDPGGLQCAWARQMGG                 SEQ ID NO: 464
GGVHRIPWCTLDPGGLQCAWARQM                 SEQ ID NO: 465
GGVHRIPWCTLDPGGLQCAWARQMGG               SEQ ID NO: 466
VHRIPWCTLDPGGLQCA                        SEQ ID NO: 467
VHRIPWCTLDPGGLQCAWVRQMGG                 SEQ ID NO: 468
GGVHRIPWCTLDPGGLQCAWVRQM                 SEQ ID NO: 469
GGVHRIPWCTLDPGGLQCAWVRQMGG               SEQ ID NO: 470
VHRIPWCTLDPGGLQCAWIRQM                   SEQ ID NO: 471
VHRIPWCTLDPGGLQCAWIRQMGG                 SEQ ID NO: 472
GGVHRIPWCTLDPGGLQCAWIRQM                 SEQ ID NO: 473
GGVHRIPWCTLDPGGLQCAWIRQMGG               SEQ ID NO: 474
IEGRGGQCIHWDIETLLSCV                     SEQ ID NO: 475
IEGRGGVPWCTLDPGSLQCAWF                   SEQ ID NO: 476
IEGRGGRYECADLPGGLHCEFR                   SEQ ID NO: 477
RSCLWQPGALHCTWWAEEEPV                    SEQ ID NO: 478
GGIEGRGGQCIHWDIETLLSCV                   SEQ ID NO: 479
GGIEGRGGVPWCTLDPGSLQCAWF                 SEQ ID NO: 480
GGIEGRGGRYECADLPGGLHCEFR                 SEQ ID NO: 481
GGRSCLWQPGALHCTWWAEEEPV                  SEQ ID NO: 482
QCVHWDLDTLFGCIREQLELGG                   SEQ ID NO: 483
GGQCVHWDLDTLFGCIREQLEL                   SEQ ID NO: 484
GGQCVHWDLDTLFGCIREQLELGG                 SEQ ID NO: 485
GGHLGVPWCTLDPGSIQCAWLAKHGG               SEQ ID NO: 486
```

Examples of truncated IL-7Rα ligands based on SEQ ID NO: 407 and 454 include:

```
VHRIPWCTLDPGGLQCAWLRQM                   SEQ ID NO: 407
VHRIPWCTLDPGGLQCAWLRQMGG                 SEQ ID NO: 454
VHRIPWCTLDPGGLQCAWLRQ                    SEQ ID NO: 457
VHRIPWCTLDPGGLQCAWLR                     SEQ ID NO: 458
VHRIPWCTLDPG

```
                                      SEQ ID NO: 454
V H R I P W C T L D P G G L Q C A W L R Q M G G

SEQ ID NO: 490
H R I P W C T L D P G G L Q C A W L R Q M G G

SEQ ID NO: 491
R I P W C T L D P G G L Q C A W L R Q M G G

SEQ ID NO: 492
I P W C T L D P G G L Q C A W L R Q M G G

SEQ ID NO: 493
P W C T L D P G G L Q C A W L R Q M G G

SEQ ID NO: 494
W C T L D P G G L Q C A W L R Q M G G

SEQ ID NO: 495
C T L D P G G L Q C A W L R Q M G G
```

An IL-7Rα ligand provided by the present disclosure can comprise an amino acid sequence of Formula (2) (SEQ ID NO: 500), an amino acid sequence of Formula (2a) (SEQ ID NO: 501), an amino acid sequence of Formula (2b) (SEQ ID NO: 502), an amino acid sequence of Formula (2c) (SEQ ID NO: 503), an amino acid sequence of Formula (2d) (SEQ ID NO: 504), an amino acid sequence of Formula (2e) (SEQ ID NO: 505), an amino acid sequence of Formula (2f) (SEQ ID NO: 506), or an amino acid sequence of Formula (2g) (SEQ ID NO: 507):

(2)
$-X^{198}-X^{199}-X^{200}-I-P-W-C-T-L-D-P-G-X^{210}-L-Q-C-A-W-L-X^{217}-X^{218}-X^{219}-$ (2a)
$-X^{199}-X^{200}-I-P-W-C-T-L-D-P-G-X^{210}-L-Q-C-A-W-L-X^{217}-X^{218}-X^{219}-$ (2b)
$-X^{200}-I-P-W-C-T-L-D-P-G-X^{210}-L-Q-C-A-W-L-X^{217}-X^{218}-X^{209}-$ (2d)
$-I-P-W-C-T-L-D-P-G-X^{210}-L-Q-C-A-W-L-X^{217}-X^{218}-X^{219}-$ (2d)
$-X^{198}-X^{199}-X^{200}-I-P-W-C-T-L-D-P-G-X^{210}-L-Q-C-A-W-L-X^{217}-X^{218}-$ (2e)
$-X^{198}-X^{199}-X^{200}-I-P-W-C-T-L-D-P-G-X^{210}-L-Q-C-A-W-L-X^{217}-$ (2f)
$-X^{198}-X^{199}-X^{200}-I-P-W-C-T-L-D-P-G-X^{210}-L-Q-C-A-W-L-$ (2g)
$-X^{198}-X^{199}-X^{200}-I-P-W-C-T-L-D-P-X^{210}-L-Q-C-A-W-L-$ wherein,
$X^{198}$ is selected from A, G, P, S, T, and V;
$X^{199}$ is selected from F, H, W, and Y;
$X^{200}$ is selected from A, G, H, K, P, R, S, and T;
$X^{210}$ is selected form A, G, P, S, and T;
$X^{217}$ is selected from A, G, H, K, P, R, S, and T;
$X^{218}$ is selected from an amino acid and a single bond; and
$X^{219}$ is selected from an amino acid and a single bond.

The IL-7Rα ligand of any one of Formula (2)-(2g), wherein,
$X^{198}$ is selected from V and G;
$X^{199}$ is selected from H and W;
$X^{200}$ is selected from R and G;
$X^{210}$ is selected form G and S;
$X^{217}$ is selected from R and G;
$X^{218}$ is selected from Q, G, K and a single bond; and
$X^{219}$ is selected from G, H, M, and a single bond.

In an IL-7Rα ligand of any one of Formula (2)-(2g), $X^{198}$ can be V, $X^{199}$ can be H, and $X^{200}$ can be R.

In an IL-7Rα ligand of any one of Formula (2)-(2g), $X^{198}$ can be G, $X^{199}$ can be W, and $X^{200}$ can be G In an IL-7Rα ligand of any one of Formula (2)-(2g), $X^{210}$ can be G.

In an IL-7Rα ligand of any one of Formula (2)-(2g), $X^{210}$ can be S.

In an IL-7Rα ligand of any one of Formula (2)-(2g), $X^{217}$ can be R.

In an IL-7Rα ligand of any one of Formula (2)-(2g), $X^{217}$ can be R, $X^{218}$ can be Q, and $X^{219}$ can be M.

In an IL-7Rα ligand of any one of Formula (2)-(2g), $X^{217}$ can be G, $X^{218}$ can be K, and $X^{219}$ can be H.

In an IL-7Rα ligand of Formula (2)-(2g), the IL-7Rα ligand can be defined by any combination of variables as defined in the immediately preceding nine (9) paragraphs.

An IL-7Rα ligand can comprise an amino acid sequence or a truncated amino acid sequence selected from any one of SEQ ID NO: 508-556:

```
                          SEQ ID NO: 437
I P W C T L D P G G L Q C A W L

SEQ ID NO: 436
I P W C T L D P G G L Q C A W L R

SEQ ID NO: 435
I P W C T L D P G G L Q C A W L R Q

SEQ ID NO: 508
I P W C T L D P G G L Q C A W L R G

SEQ ID NO: 509
I P W C T L D P G G L Q C A W L R Q G

SEQ ID NO: 510
I P W C T L D P G G L Q C A W L R G G

SEQ ID NO: 511
I P W C T L D P G G L Q C A W L G

SEQ ID NO: 512
I P W C T L D P G G L Q C A W L G K

SEQ ID NO: 513
I P W C T L D P G G L Q C A W L G K H

SEQ ID NO: 514
V H R I P W C T L D P G G L Q C A W L

SEQ ID NO: 458
V H R I P W C T L D P G G L Q C A W L R

SEQ ID NO: 457
V H R I P W C T L D P G G L Q C A W L R Q

SEQ ID NO: 515
V H R I P W C T L D P G G L Q C A W L R G

SEQ ID NO: 516
V H R I P W C T L D P G G L Q C A W L R Q G
```

```
VHRIPWCTLDPGGLQCAWLRGG     SEQ ID NO: 517
VHRIPWCTLDPGGLQCAWLG       SEQ ID NO: 518
VHRIPWCTLDPGGLQCAWLGK      SEQ ID NO: 519
VHRIPWCTLDPGGLQCAWLGKH     SEQ ID NO: 520
GWGIPWCTLDPGGLQCAWL        SEQ ID NO: 521
GWGIPWCTLDPGGLQCAWLR       SEQ ID NO: 522
GWGIPWCTLDPGGLQCAWLRQ      SEQ ID NO: 523
GWGIPWCTLDPGGLQCAWLRG      SEQ ID NO: 524
GWGIPWCTLDPGGLQCAWLRQG     SEQ ID NO: 525
GWGIPWCTLDPGGLQCAWLRGG     SEQ ID NO: 526
GWGIPWCTLDPGGLQCAWLG       SEQ ID NO: 527
GWGIPWCTLDPGGLQCAWLGK      SEQ ID NO: 528
GWGIPWCTLDPGGLQCAWLGKH     SEQ ID NO: 529
IPWCTLDPGSLQCAWL           SEQ ID NO: 530
IPWCTLDPGSLQCAWLR          SEQ ID NO: 531
IPWCTLDPGSLQCAWLRQ         SEQ ID NO: 532
IPWCTLDPGSLQCAWLRG         SEQ ID NO: 533
IPWCTLDPGSLQCAWLRQG        SEQ ID NO: 534
IPWCTLDPGSLQCAWLRGG        SEQ ID NO: 535
IPWCTLDPGSLQCAWLG          SEQ ID NO: 536
IPWCTLDPGSLQCAWLGK         SEQ ID NO: 537
IPWCTLDPGSLQCAWLGKH        SEQ ID NO: 538
VHRIPWCTLDPGSLQCAWL        SEQ ID NO: 539
VHRIPWCTLDPGSLQCAWLR       SEQ ID NO: 540
VHRIPWCTLDPGSLQCAWLRQ      SEQ ID NO: 541
VHRIPWCTLDPGSLQCAWLRG      SEQ ID NO: 542
VHRIPWCTLDPGSLQCAWLRQG     SEQ ID NO: 543
VHRIPWCTLDPGSLQCAWLRGG     SEQ ID NO: 544
VHRIPWCTLDPGSLQCAWLG       SEQ ID NO: 545
VHRIPWCTLDPGSLQCAWLGK      SEQ ID NO: 546
VHRIPWCTLDPGSLQCAWLGKH     SEQ ID NO: 547
GWGIPWCTLDPGSLQCAWL        SEQ ID NO: 548
GWGIPWCTLDPGSLQCAWLR       SEQ ID NO: 549
GWGIPWCTLDPGSLQCAWLRQ      SEQ ID NO: 550
GWGIPWCTLDPGSLQCAWLRG      SEQ ID NO: 551
GWGIPWCTLDPGSLQCAWLRQG     SEQ ID NO: 552
GWGIPWCTLDPGSLQCAWLRGG     SEQ ID NO: 553
GWGIPWCTLDPGSLQCAWLG       SEQ ID NO: 554
GWGIPWCTLDPGSLQCAWLGK      SEQ ID NO: 555
GWGIPWCTLDPGSLQCAWLGKH     SEQ ID NO: 556
```

An IL-7Rα ligand provided by the present disclosure can comprise a truncated amino acid sequence of any one of SEQ ID NO: 420-556.

An IL-7Rα ligand provided by the present disclosure can comprise an amino acid sequence selected from any one of SEQ ID NO: 420-556, or a truncated amino acid sequence of any one of SEQ ID NO: 420-556, wherein the amino acid sequence can independently comprise from 1 to 4 glycines (G) (SEQ ID NO: 2045) on the N-terminus, on the C-terminus, or on both the N- and C-termini.

An IL-7Rα ligand provided by the present disclosure can comprise an amino acid sequence selected from any one of SEQ ID NO: 420-556, or a truncated amino acid sequence of any one of SEQ ID NO: 420-486, wherein the amino acid sequence comprises one or more amino acid substitutions such as from 1 to 5 amino acid substitutions. The amino acid substitutes can comprise conservative amino acid substitutions.

An IL-7Rα ligand can comprise an amino acid sequence or a truncated amino acid sequence similarity greater than 60%, greater than 70%, greater than 75%, greater than 80%, greater than 85%, greater than 90%, or greater than 95% to the amino acid sequence of any one of SEQ ID NO: 420-556.

An IL-7Rα ligand of any one of SEQ ID NO: 420-556 bound to the hIL-7Rα subunit with an $IC_{50}$ of less than 10 µM as determined using phage ELISA competition assays.

Certain IL-7Rα ligands provided by the present disclosure can bind to a unique binding site on the IL-7Rα subunit that is different from the binding site on the IL-7Rα subunit to which IL-7 binds.

IL-7Rα ligands having SEQ ID NOS: 5, 43, 104, 146, and 313 do not bind competitively with IL-7 binding to IL-7Rα, indicating that the IL-7Rα ligand binding site for these compounds is distinct from that of IL-7. This group of IL-7Rα ligands bind to a unique binding site on the IL-7Rα subunit with an $IC_{50}$ of less than 10 μM.

An Rγc ligand can include an Rγc ligand disclosed in U.S. Application Publication No. 2020/0040036, which is incorporated by reference in its entirety.

An Rγc ligand provided by the present disclosure binds to the human Rγc subunit with an $IC_{50}$ of less than 100 μM, less than 10 μM, less than 1 μM, less than 0.1 μM, or less than 0.01 μM.

An Rγc ligand provided by the present disclosure binds to the human Rγc subunit with an $IC_{50}$ from 1 pM to 100 μM, from 10 μM to 10 μM, from 100 pM to 1 μM, from, 0.001 μM to 1 μM, or from 0.01 μM to 1 μM.

An Rγc ligand provided by the present disclosure binds to a mammalian Rγc subunit, for example, with an $IC_{50}$ of less than 100 μM, less than 10 μM, less than 1 μM, less than 0.1 μM, or less than 0.01 μM.

An Rγc ligand provided by the present disclosure binds to a mammalian Rγc subunit, for example, with an $IC_{50}$ from 1 pM to 100 μM, from 10 μM to 10 μM, from 100 pM to 1 μM, from, 0.001 μM to 1 μM, or from 0.01 μM to 1 μM.

An Rγc ligand can comprise the amino acid sequence of Formula (3) (SEQ ID NO: 9438), Formula (3a) (SEQ ID NO: 9439), Formula (3b) (SEQ ID NO: 9440), Formula (3c) (SEQ ID NO: 9441), Formula (3d) (SEQ ID NO: 9442), or Formula (3e) (SEQ ID NO: 9443):

$$\text{(3)} \quad -X^{171}-X^{172}-X^{173}-X^{174}-X^{175}-C-X^{176}-X^{177}-X^{178}-X^{179}-$$
$$X^{180}-X^{181}-X^{182}-X^{183}-C-X^{184}-X^{185}-X^{186}-X^{187}-X^{188}-$$

$$\text{(3a)} \quad -X^{172}-X^{173}-X^{174}-X^{175}-C-X^{176}-X^{177}-X^{178}-X^{179}-X^{180}-$$
$$X^{181}-X^{182}-X^{183}-C-X^{184}-X^{185}-X^{186}-X^{187}-$$

$$\text{(3b)} \quad -X^{173}-X^{174}-X^{175}-C-X^{176}-X^{177}-X^{178}-X^{179}-X^{180}-X^{181}-$$
$$X^{182}-X^{183}-C-X^{184}-X^{185}-X^{186}-$$

$$\text{(3c)} \quad -X^{174}-X^{175}-C-X^{176}-X^{177}-X^{178}-X^{179}-X^{180}-X^{181}-X^{182}-$$
$$X^{183}-C-X^{184}-X^{185}-$$

$$\text{(3d)} \quad -X^{175}-C-X^{176}-X^{177}-X^{178}-X^{179}-X^{180}-X^{181}-X^{182}-X^{183}-$$
$$C-X^{184}-$$

$$\text{(3e)} \quad -C-X^{176}-X^{177}-X^{178}-X^{179}-X^{180}-X^{181}-X^{182}-X^{183}-C-$$

wherein, $X^{171}$ can be selected from an amino acid comprising a basic side chain; $X^{172}$ can be selected from an amino acid comprising a hydroxyl-containing side chain; $X^{173}$ can be selected from an amino acid comprising an acidic side chain or a large hydrophobic side chain; $X^{174}$ can be selected from an amino acid comprising a large hydrophobic side chain; $X^{175}$ can be selected from an amino acid comprising an acidic side chain or a large hydrophobic side chain; $X^{176}$ can be selected from an amino acid comprising an acidic side chain or a polar/neutral side chain; $X^{177}$ can be selected from an amino acid comprising an acidic side chain; $X^{178}$ can be selected from an amino acid comprising a large hydrophobic side chain or an aromatic side chain; $X^{179}$ can be selected from an amino acid comprising an acidic side chain or a polar/neutral side chain; $X^{180}$ can be G; $X^{181}$ can be V; $X^{182}$ can be E; $X^{183}$ can be L; $X^{184}$ can be W; $X^{185}$ can be selected from an amino acid comprising a large hydrophobic side chain; $X^{186}$ can be E; $X^{187}$ can be selected from an amino acid; and $X^{188}$ can be selected from an amino acid comprising an acidic side chain.

In Rγc ligands of Formula (3), (3a), (3b), (3c), (3d), and/or (3e), $X^{171}$ can be selected from H, K, and R; $X^{172}$ can be selected from S, T, and Y; $X^{173}$ can be selected from D, E, F, I, L, M, V, W, and Y; $X^{174}$ can be selected from F, I, L, M, V, W, and Y; $X^{175}$ can be selected from D, E, F, I, L, M, V, W, and Y; $X^{176}$ can be selected from D, E, H, N, Q, S, T, and Y; $X^{177}$ can be selected from D and E; $X^{178}$ can be selected from F, H, I, L, M, V, W, and Y; $X^{179}$ can be selected from D, E, H, N, Q, S, T, and Y; $X^{180}$ can be G; $X^{181}$ can be V; $X^{182}$ can be E; $X^{183}$ can be L; $X^{184}$ can be W; $X^{185}$ can be selected from F, I, L, M, V, W, Y, H, N, Q, S, and T; $X^{186}$ can be E; $X^{187}$ can be selected from an amino acid; and $X^{188}$ can be selected from D and E.

In Rγc ligands of Formula (3), (3a), (3b), (3c), (3d), and/or (3e), $X^{171}$ can be selected from D, E, G, H, K, M, N, P, Q, R, S, and T; $X^{172}$ can be selected from A, D, E, G, I, K, L, P, Q, R, S, T, V, W, and Y; $X^{173}$ can be selected from A, D, E, F, G, I, Q, S, T, V, W, and Y; $X^{174}$ can be selected from A, I, E, I, L, M, N, Q, R, S, T, and V; $X^{175}$ can be selected from A, E, I, L, M, N, Q, R, S, T, and V; $X^{176}$ can be selected from D, E, H, L, Q, R, and V; $X^{177}$ can be selected from D, E, N, T, and V; $X^{178}$ can be selected from F, S, W, and Y; $X^{179}$ can be selected from A, D, E, G, H, K, N, Q, R, and Y; $X^{180}$ can be selected from G and R; $X^{181}$ can be V; $X^{182}$ can be selected from D, E, and Y; $X^{183}$ can be selected from F, I, and L; $X^{184}$ can be W; $X^{185}$ can be selected from C, H, I, L, P, Q, T, V, and Y; $X^{186}$ can be selected from A, D, E, G, M, R, S, T, and V; $X^{187}$ can be selected from A, D, E, F, G, I, M, N, P, Q, R, S, T, V, W, and Y; and $X^{188}$ can be selected from A, C, D, E, F, G, I, K, L, N, P, Q, R, S, and V.

In Rγc ligands of Formula (3), (3a), (3b), (3c), (3d), and/or (3e), $X^{171}$ can be selected from H, K, and R; $X^{172}$ can be selected from S, T, and Y; $X^{173}$ can be selected from D, E, F, I, and V; $X^{174}$ can be selected from I and V; $X^{175}$ can be selected from E, I, L, M, and V; $X^{176}$ can be selected from D, E, and Q; $X^{177}$ can be selected from D and E; $X^{178}$ can be selected from F and W; $X^{179}$ can be selected from D, E, N, and Q; $X^{180}$ can be G; $X^{181}$ can be V; $X^{182}$ can be selected from D and E; $X^{183}$ can be L; $X^{184}$ can be W; $X^{185}$ can be selected from I, L, Q, and V; $X^{186}$ can be selected from D and E; $X^{187}$ can be selected from A, D, E, F, G, I, M, N, P, Q, R, S, T, V, W, and Y; and $X^{188}$ can be selected from D, E, N, and Q.

In Rγc ligands of Formula (3), (3a), (3b), (3c), (3d), and/or (3e), $X^{171}$ can be selected from K and R; $X^{172}$ can be selected from S, T, and Y; $X^{173}$ can be selected from D, E, F, I, and V; $X^{174}$ can be V; $X^{175}$ can be selected from E, L, M, and V; $X^{176}$ can be Q; $X^{177}$ can be selected from D and E; $X^{178}$ can be W; $X^{179}$ can be selected from D, E, N, and Q; $X^{180}$ can be G; $X^{181}$ can be V; $X^{182}$ can be E; $X^{183}$ can be L; $X^{184}$ can be W; $X^{185}$ can be selected from I, L, Q, and V; $X^{186}$ can be selected from D and E; $X^{187}$ can be selected from A, D, E, F, G, I, M, N, P, Q, R, S, T, V, W, and Y; and $X^{188}$ can be selected from D, E, N, and Q.

In Rγc ligands of Formula (3), $X^{171}$ can be selected from H, K, and R.

In Rγc ligands of Formula (3)-(3a), $X^{172}$ can be selected from S, T, and Y.

In Rγc ligands of Formula (3)-(3b), $X^{173}$ can be selected from D, E, F, I, L, M, V, W, and Y.

In Rγc ligands of Formula (3)-(3b), $X^{173}$ can be selected from D and E.

In Rγc ligands of Formula (3)-(3b), $X^{173}$ can be selected from F, I, L, M, V, W, and Y.

In Rγc ligands of Formula (3)-(3c), $X^{174}$ can be selected from F, I, L, M, V, W, and Y.

In Rγc ligands of Formula (3)-(3c), $X^{174}$ can be V.

In Rγc ligands of Formula (3)-(3d), $X^{175}$ can be selected from D, E, F, I, L, M, V, W, and Y.

In Rγc ligands of Formula (3)-(3d), $X^{175}$ can be selected from D and E.

In Rγc ligands of Formula (3)-(3d), $X^{175}$ can be selected from F, I, L, M, V, W, and Y.

In Rγc ligands of Formula (3)-(3e), $X^{176}$ can be selected from D, E, H, N, Q, S, T, and Y.

In Rγc ligands of Formula (3)-(3e), $X^{176}$ can be selected from E and Q.

In Rγc ligands of Formula (3)-(3e), $X^{177}$ can be selected from D and E.

In Rγc ligands of Formula (3)-(3e), $X^{178}$ can be selected from F, H, I, L, M, V, W, and Y.

In Rγc ligands of Formula (3)-(3e), $X^{178}$ can be selected from F, H, W, and Y.

In Rγc ligands of Formula (3)-(3e), $X^{178}$ can be W.

In Rγc ligands of Formula (3)-(3e), $X^{179}$ can be selected from D, E, H, N, Q, S, T, and Y.

In Rγc ligands of Formula (3)-(3e), $X^{179}$ can be selected from D, E, and Q.

In Rγc ligands of Formula (3)-(3e), $X^{180}$ can be G.

In Rγc ligands of Formula (3)-(3e), $X^{181}$ can be V.

In Rγc ligands of Formula (3)-(3e), $X^{182}$ can be E.

In Rγc ligands of Formula (3)-(3e), $X^{183}$ can be L.

In Rγc ligands of Formula (3)-(3d), $X^{184}$ can be W.

In Rγc ligands of Formula (3)-(3c), $X^{185}$ can be selected from F, I, L, M, V, W, and Y.

In Rγc ligands of Formula (3)-(3c), $X^{185}$ can be L.

In Rγc ligands of Formula (3)-(3b), $X^{186}$ can be E.

In Rγc ligands of Formula (3)-(3a), $X^{187}$ can be selected from an amino acid.

In Rγc ligands of Formula (3), $X^{188}$ can be selected from D and E.

In Rγc ligands of Formula (3), (3a), (3b), (3c), (3d), and/or (3e), $X^{171}$ can be selected from H, K, and R; $X^{172}$ can be selected from S, T, and Y; $X^{173}$ can be selected from D, E, F, I, L, M, V, W, and Y; $X^{174}$ can be selected from F, I, L, M, V, W, and Y; $X^{175}$ can be selected from D, E, F, I, L, M, V, W, and Y; $X^{176}$ can be selected from D, E, H, N, Q, S, T, and Y; $X^{177}$ can be selected from D and E; $X^{178}$ can be selected from F, H, I, L, M, V, W, and Y; $X^{179}$ can be selected from D, E, H, N, Q, S, T, and Y; $X^{180}$ can be G; $X^{181}$ can be V; $X^{182}$ can be E; $X^{183}$ can be L; $X^{184}$ can be selected from W; $X^{185}$ can be selected from F, I, L, M, V, W, and Y; $X^{186}$ can be E; $X^{187}$ can be selected from an amino acid; and $X^{188}$ can be selected from D and E.

In Rγc ligands of Formula (3), (3a), (3b), (3c), (3d), and/or (3e), $X^{171}$ can be selected from H, K, and R; $X^{172}$ can be selected from S, T, and Y; $X^{173}$ can be selected from D and E; $X^{174}$ can be V; $X^{175}$ can be selected from D and E; $X^{176}$ can be selected from E and Q; $X^{177}$ can be selected from D and E; $X^{171}$ can be selected from F, H, W, and Y; $X^{179}$ can be selected from D, E, and Q; $X^{180}$ can be G; $X^{181}$ can be V; $X^{182}$ can be E; $X^{183}$ can be L; $X^{184}$ can be W; $X^{185}$ can be selected from F, I, L, M, V, W, Y, H, N, Q, S, and T; $X^{186}$ can be E; $X^{187}$ can be selected from an amino acid; and $X^{188}$ can be selected from D and E.

In Rγc ligands of Formula (3), (3a), (3b), (3c), (3d), and/or (3e), $X^{171}$ can be selected from H, K, and R; $X^{172}$ can be selected from S, T, and Y; $X^{173}$ can be selected from F, I, L, M, V, W, and Y; $X^{174}$ can be V; $X^{175}$ can be selected from F, I, L, M, V, W, and Y; $X^{176}$ can be selected from E and Q; $X^{177}$ can be selected from D and E; $X^{178}$ can be selected from F, H, W, and Y; $X^{179}$ can be selected from D, E, and Q; $X^{180}$ can be G; $X^{181}$ can be V; $X^{182}$ can be E; $X^{183}$ can be L; $X^{184}$ can be W; $X^{185}$ can be selected from F, I, L, M, V, W, Y, H, N, Q, S, and T; $X^{186}$ can be E; $X^{187}$ can be selected from an amino acid; and $X^{188}$ can be selected from D and E.

In Rγc ligands of Formula (3), (3a), (3b), (3c), (3d), and/or (3e), $X^{171}$ can be selected from H, K, and R; $X^{172}$ can be selected from S, T, and Y; $X^{173}$ can be selected from D, E, F, I, L, M, V, W, and Y; $X^{174}$ can be V; $X^{175}$ can be selected from D, E, F, I, L, M, V, W, and Y; $X^{176}$ can be selected from D, E, H, N, Q, S, T, and Y; $X^{176}$ can be selected from E and Q; $X^{177}$ can be selected from D and E; $X^{171}$ can be W; $X^{179}$ can be selected from D, E, and Q; $X^{180}$ can be G; $X^{181}$ can be V; $X^{182}$ can be E; $X^{183}$ can be L; $X^{184}$ can be W; $X^{185}$ can be selected from F, I, L, M, V, W, Y, H, N, Q, S, and T; $X^{186}$ can be E; $X^{187}$ can be selected from an amino acid; and $X^{188}$ can be selected from D and E.

An Rγc ligand can comprise an amino acid sequence selected from any one of SEQ ID NO: 950-1028:

```
                                        SEQ ID NO: 950
I E C D T S Y G V Y I C W Q

SEQ ID NO: 951
I E C E E W R G V E L C W Q

SEQ ID NO: 952
P E G R E V V V C R D W Y G V E L C W Q

SEQ ID NO: 953
I W G R T V V E C Q D W E G V E L C W Q

SEQ ID NO: 954
L A L R K E V V C Q E Y Y G V E L C W I

SEQ ID NO: 955
H E A R E V V V C Q D W Y G V E L C W Q

SEQ ID NO: 956
M V N R E V V V C E D W Y G V E L C W Q

SEQ ID NO: 957
T A N Q T V V E C Q V W G G V E L C W Q

SEQ ID NO: 958
V E C Q E W G G V E L C W C

SEQ ID NO: 959
D V E C V D W G G V E L C W H

SEQ ID NO: 960
I V C E E W R G V E L C W L

SEQ ID NO: 961
D F E R S Y V V C Q D W D G V E L C W I

SEQ ID NO: 962
A H S R Q E V V C E E W Y G V E L C W I

SEQ ID NO: 963
S A P E R W V E C E D W Q G V E L C W V

SEQ ID NO: 964
Y S R E L Y V Q C E D W E G V E L C W I

SEQ ID NO: 965
V V C Q D W E G V E L C W Q

SEQ ID NO: 966
D V V C Q N W E G V D L C W H

SEQ ID NO: 967
S A G R Q E V V C Q D W N G V E L C W I
```

GQGREVVVCHDWYGVELCWQ  SEQ ID NO: 968

DWRRSVVECQDWYGVELCWQ  SEQ ID NO: 969

DVVCQNWDGVDLCWH  SEQ ID NO: 970

TLGRTVVECQDWGGVELCWQ  SEQ ID NO: 971

RLLNSVVECLDWEGVELCWQ  SEQ ID NO: 972

IVCEDWRGVELCWI  SEQ ID NO: 973

VVCQEWEGVELCWC  SEQ ID NO: 974

GDRPKEVVCEDWKGVELCWI  SEQ ID NO: 975

ERPRSFIECQEWEGVELCWL  SEQ ID NO: 976

EGSTTTIECEEWAGVELCWL  SEQ ID NO: 977

ANQNTVVECQDWHGVELCWQ  SEQ ID NO: 978

RSDDEVVVCQEWEGVELCWQ  SEQ ID NO: 979

IECEEWAGVELCWL  SEQ ID NO: 980

TWNMSELECQDWNGVEICWH  SEQ ID NO: 981

GNDDSYIVCEEWKGVELCWI  SEQ ID NO: 982

FAHHGVVECQEWYGVELCWQ  SEQ ID NO: 983

LNRSVWIECEEYEGVELCWL  SEQ ID NO: 984

WSKKAEVVCEEWGGVEFCWI  SEQ ID NO: 985

RSNQTVVECQDWEGVELCWQ  SEQ ID NO: 986

VVCQEWEGVELCWYAGECMQ  SEQ ID NO: 987

ILCQEFEGVELCWLEESLAE  SEQ ID NO: 988

KSQVECQDWEGVELCWVVSE  SEQ ID NO: 989

KITVECQDWDGVELCWPTWI  SEQ ID NO: 990

RPQIECQEWQGVELCWTREE  SEQ ID NO: 991

VSCQEWDGVELCWVDGDLAA  SEQ ID NO: 992

IMCQEWDGVELCWLERDKAN  SEQ ID NO: 993

GLEIACEDWYGVELCWLRRA  SEQ ID NO: 994

GYGVLCQEWQGVELCWPVQREAGV  SEQ ID NO: 995

PYGVVCQDWAGVELCWVENR  SEQ ID NO: 996

KLTVECQDWDGVELCWVGVE  SEQ ID NO: 997

INCQTWNGVELCWVDEGLYQ  SEQ ID NO: 998

VVCQEWEGVELCWVEPPLLP  SEQ ID NO: 999

RVQVECEDWNGVELCWPVRV  SEQ ID NO: 1000

DRQVVCEEWDGVELCWIEES  SEQ ID NO: 1001

KTTVACQDWGGVELCWVERV  SEQ ID NO: 1002

RPEVVCQEWEGVELCWISPL  SEQ ID NO: 1003

RLGVECQEWEGVDLCWISAF  SEQ ID NO: 1004

KPVVCEEWQGVELCWLEIQ  SEQ ID NO: 1005

VVCEVFQGVELCWCENEEFT  SEQ ID NO: 1006

TDEVSCQEWEGVELCWIERQ  SEQ ID NO: 1007

PVEVRCQEWEGVELCWVVGI  SEQ ID NO: 1008

GPEVVCEEFNRVELCWVEYN  SEQ ID NO: 1009

KYIVECQEWGGVELCWPEMV  SEQ ID NO: 1010

VTCQEYEGVELCWTVGCAYS  SEQ ID NO: 1011

VVCQEWEGVELCWQTGPGAHA  SEQ ID NO: 1012

IVCEEYNGVELCWVETSVKP  SEQ ID NO: 1013

EQQVVCQEWNGVELCWIEAG  SEQ ID NO: 1014

QLGVECQNWRGVELCWVSEI  SEQ ID NO: 1015

TAEVVCQEWDGVELCWIEVL  SEQ ID NO: 1016

SPSIVCEEWAGVELCWVDYS  SEQ ID NO: 1017

AVCQDWYGVELCWCMQDILD  SEQ ID NO: 1018

VECEEWGGVELCWLADEVMW  SEQ ID NO: 1019

HSTVICQDWDGVELCWIEND  SEQ ID NO: 1020

KKIVVCQDWGGVELCWTEDD  SEQ ID NO: 1021

-continued

SEQ ID NO: 1022
S V E V V C E E W H G V E L C W P V F I

SEQ ID NO: 1023
R W A V S C Q D W Q G I E L C W P E W D

SEQ ID NO: 1024
R T G V E C Q D W H G V E L C W P V W E

SEQ ID NO: 1025
G Y G V V C E D F R G V E L C W L E R K

SEQ ID NO: 1026
R T E V E C E D W E G V E L C W L

SEQ ID NO: 1027
I L C E E W Q G V E L C W L E G G G S

SEQ ID NO: 1028
V G I E C E E W A G V E L C W L

A Rγc ligand provided by the present disclosure can comprise a truncated amino acid sequence of any one of SEQ ID NOS: 944-1028 and 9438-9443.

A Rγc ligand provided by the present disclosure can comprise an amino acid sequence selected from any one of SEQ ID NOS: 944-1028 and 9438-9443, or a truncated amino acid sequence of any one of SEQ ID NOS: 944-1028 and 9438-9443, wherein the amino acid sequence can independently comprise from 1 to 5 glycines (G) (SEQ ID NO: 9390) on the N-terminus, on the C-terminus, or on both the N- and C-termini.

A Rγc ligand provided by the present disclosure can comprise an amino acid sequence selected from any one of SEQ ID NOS: 944-1028 and 9438-9443, or a truncated amino acid sequence of any one of SEQ ID NOS: 944-1028 and 9438-9443 wherein the amino acid sequence comprises one or more amino acid substitutions such as from 1 to 5 amino acid substitutions. An amino acid substitution can be a conservative amino acid substitution.

A Rγc ligand of any one of SEQ ID NOS: 950-1028, bind to the human Rγc subunit with an IC$_{50}$ of less than 100 μM.

A Rγc ligand can comprise an amino acid sequence having an amino acid similarity greater than 60%, greater than 70%, greater than 75%, greater than 80%, greater than 85%, greater than 90%, or greater than 95% to the amino acid sequence of any one of SEQ ID NOS: 944-1028 and 9438-9443.

An Rγc ligand can comprise an amino acid sequence having an amino acid sequence similarity greater than 60%, greater than 70%, greater than 75%, greater than 80%, greater than 85%, greater than 90%, or greater than 95%, to the amino acid sequence of any one of SEQ ID NOS: 944-1028 and 9438-9443.

A Rγc ligand can comprise an amino acid sequence selected from any one of SEQ ID NOS: 965 and 1029-1031:

SEQ ID NO: 965
V V C Q D W E G V E L C W Q

SEQ ID NO: 1029
V V C Q D W E G V E L C W Q G G

SEQ ID NO: 1030
G G V V C Q D W E G V E L C W Q

SEQ ID NO: 1031
G G V V C Q D W E G V E L C W Q G G

A Rγc ligand provided by the present disclosure can comprise a truncated amino acid sequence of any one of SEQ ID NOS: 965 and 1029-1031.

A Rγc ligand provided by the present disclosure can comprise an amino acid sequence selected from any one of SEQ ID NOS: 965 and 1029-1031, or a truncated amino acid sequence of any one of SEQ ID NOS: 1029-1031, wherein the amino acid sequence can independently comprise from 1 to 5 glycines (G) (SEQ ID NO: 9390) on the N-terminus, on the C-terminus, or on both the N- and C-termini.

A Rγc ligand provided by the present disclosure can comprise an amino acid sequence selected from any one of SEQ ID NOS: 965 and 1029-1031, or a truncated amino acid sequence of any one of SEQ ID NOS: 965 and 1029-1031, wherein the amino acid sequence comprises one or more amino acid substitutions such as from 1 to 5 amino acid substitutions. An amino acid substitution can be a conservative amino acid substitution.

A Rγc ligand of any one of SEQ ID NOS: 965 and 1029-1031 bind to the human Rγc subunit with an IC$_{50}$ of less than 100 μM.

An Rγc ligand can comprise an amino acid sequence having an amino acid similarity greater than 60%, greater than 70%, greater than 75%, greater than 80%, greater than 85%, greater than 90%, or greater than 95% to the amino acid sequence of any one of SEQ ID NOS: 965 and 1029-1031.

An Rγc ligand can comprise an amino acid sequence having an amino acid sequence similarity greater than 60%, greater than 70%, greater than 75%, greater than 80%, greater than 85%, greater than 90%, or greater than 95%, to the amino acid sequence of any one of SEQ ID NOS: 965 and 1029-1031.

Certain Rγc ligands provided by the present disclosure can bind to a specific binding site on the Rγc subunit that is different than the Rγc binding site on the Rγc subunit to which IL-2 or IL-7 binds.

These Rγc ligands do not compete for binding to the specific Rγc binding site with IL-2 or IL-7, have no detectable binding to the IL-7Rα subunit, and bind to the Rγc subunit with an IC$_{50}$ of less than 10 μM.

The specific binding site on the Rγc subunit can be characterized by at least the following properties: (1) a group of Rγc ligands bind to the specific binding site on the Rγc subunit with an IC$_{50}$ of less than 10 μM; (2) Rγc ligands within the group competitively bind to the specific binding site on the Rγc subunit with each of the other Rγc ligands within the group; and (3) Rγc ligands within the group do not compete for binding to the specific binding site with an Rγc ligand having the amino acid sequence of SEQ ID NO: 930.

An IL-7Rα ligand having the amino acid sequence of SEQ ID NO: 58 does not compete for binding to the binding site with the group of Rγc ligands.

The group of Rγc ligands comprises Rγc ligands having an amino acid sequence of SEQ ID NOS: 198, 202, 224, 236, 248, and 266.

Rγc ligands within the group of Rγc ligands can bind to the Rγc subunit with an IC$_{50}$ of less than 100 μM and can bind to the Rα subunit with an IC$_{50}$ of greater than 100 μM.

The specific binding site of the Rγc subunit for these Rγc ligands can be characterized using competitive binding assays as described, for example, in Example 13.

IL-7Rα ligands and/or Rγc ligands can comprise one or more flanking amino acids bound to the N-terminus and/or to the C-terminus of the ligand.

The flanking amino acids can separate the portion of the ligand that interacts with IL-7R from other portions of the ligand and/or ligand construct.

An IL-7Rα ligand and/or Rγc ligand can comprise flanking amino acids such as, for example, from 1 to 20 amino acids, from 1 to 10 amino acids, such as from 1 to 8 amino acids, from 2 to 6 amino acids, or from 2 to 4 amino acids bound to the N-terminus and/or the C-terminus of the IL-7Rα and/or Rγc ligand.

Flanking amino acids can comprise any suitable naturally occurring or non-naturally occurring amino acids.

For example, flanking amino acids can be selected from serine and flexible amino acids such as serine.

An IL-7Rα ligand and/or an Rγc ligand can comprise flanking amino acids such as, for example, terminal glycine groups on the N-terminus and/or the C-terminus of the respective ligand. For example, an IL-7Rα and an Rγc ligand can comprise flanking amino acids such as (-G-)$_n$ glycine groups where n is from 1 to 10 (SEQ ID NO: 9385), from 1 to 8, from 2 to 6, from 2 to 4, or from 2 to 3. For example, each of an IL-7Rα ligand and an Rγc ligand can independently comprise flanking amino acids such as 1, 2 or 3 terminal glycine groups. For example, a ligand having SEQ ID NO: 400, -Q-C-I-H-W-D-I-E-T-L-L-S-C-V-, can independently include flanking glycines such as -G-, -G-G- (SEQ ID NO: 9399), or -G-G-G- or (SEQ ID NO: 9400) both the N-terminus and the C-terminus such that the ligand can have the amino acid sequence, for example, -G-Q-C-I-H-W-D-I-E-T-L-L-S-C-V-G- (SEQ ID NO: 497), -G-G-Q-C-I-H-W-D-I-E-T-L-L-S-C-V-G-G- (SEQ ID NO: 498), or -G-G-G-Q-C-I-H-W-D-I-E-T-L-L-S-C-V-G-(SEQ ID NO: 499), respectively.

An IL-7Rαγc ligand can comprise an IL-7Rα ligand and an Rγc ligand in which the IL-7Rα ligand is directly bound to the Rγc ligand.

An IL-7Rαγc ligand can comprise an IL-7Rα ligand and an Rγc ligand bound to an IL-7Rαγc ligand linker.

IL-7Rαγc ligands that contain more than 2 cysteines, typically have a preferred pattern of Cys-Cys bonds (disulfide bridges) that exhibit the greatest activity such as, for example, Cys 1-2, and Cys 3-4, and other disulfide patterns may exhibit desired activity, and have useful properties.

Each of an IL-7Rα ligand and an Rγc ligand can independently be covalently bound to an IL-7Rαγc ligand linker through the N-terminus or through the C-terminus of the IL-7Rαγc ligand linker. For example, an IL-7Rα ligand can be bound to the IL-7Rαγc ligand linker through the N-terminus and an Rγc ligand can be bound to an IL-7Rαγc ligand linker through the N-terminus; an IL-7Rα ligand can be bound to an IL-7Rαγc ligand linker through the N-terminus and an Rγc ligand can be bound to the IL-7Rαγc ligand linker through the C-terminus; an IL-7Rα ligand can be bound to the IL-7Rαγc ligand linker through the C-terminus and an Rγc ligand can be bound to the IL-7Rαγc ligand linker through the N-terminus; or an IL-7Rα ligand can be bound to the IL-7Rαγc ligand linker through the C-terminus and an Rγc ligand can be bound to the IL-7Rαγc linker through the C-terminus.

Examples of IL-7Rαγc ligands having various orientations of the IL-7Rα and Rγc ligands are shown in FIG. 1. As shown in FIG. 1, IL-7Rαγc ligands having various C/N orientations of the IL-7Rα ligand and the Rγc ligand can be synthesized using click chemistry. The triazole linkage is a schematic representation of a synthetic IL-7Rαγc ligand linker, which can comprise various chemical moieties and can have various lengths and properties. Examples of certain IL-7Rαγc ligand linkers are shown in FIGS. 13A and 13B.

An IL-7Rαγc ligand linker can be configured to facilitate binding of an IL-7Rαγc ligand to the IL-7Rα subunit and to the Rγc subunit of IL-7R. For example, an IL-7Rαγc ligand linker can be configured to facilitate activation of IL-7R by the IL-7Rαγc ligand. For example, an IL-7Rαγc ligand can be configured to induce IL-7R-mediated STAT5 phosphorylation in TF-1-7α cells.

An IL-7Rαγc ligand linker can have a length, for example, from 2 Å to 100 Å, from 2 Å to 80 Å, from 2 Å to 60 Å, from 2 Å to 40 Å, from 2 Å to 20 Å, from 4 Å to 18 Å, from 6 Å to 16 Å, or from 8 Å to 14 Å. A ligand linker can have a length, for example, less than 100 Å, less than 80 Å, less than 60 Å, less than 40 Å, less than 20 Å, less than 15 Å, or less than 10 Å.

An IL-7Rαγc ligand linker can comprise a backbone having, for example, from 2 to 50 bonds, from 2 to 45 bonds, from 2 to 40 bonds, from 2 to 35 bonds, from 2 to 30 bonds, from 2 to 25 bonds, from 2 to 20 bonds, from 4 to 18 bonds, from 6 to 16 bonds, or from 8 to 14 bonds. An IL-7Rαγc ligand linker can comprise a backbone having, for example, less than 50 bonds, less than 40 bonds, less than 30 bonds, less than 20 bonds, or less than 10 bonds.

An IL-7Rαγc ligand linker provided by the present disclosure can comprise a peptidyl IL-7Rαγc ligand or a synthetic IL-7Rαγc linker.

An IL-7Rαγc ligand linker provided by the present disclosure can comprise a peptidyl IL-7Rαγc ligand linker.

A peptidyl ligand linker can comprise, for example, from 2 to 100 amino acids, from 2 to 80 amino acids, from 2 to 60 amino acids, from 2 to 40 amino acids, from 2 to 20 amino acids, from 5 to 10 amino acids, or from 2 to 5 amino acids. A peptidyl ligand linker can comprise, for example, less than 100 amino acids, less than 80 amino acids, less than 40 amino acids, less than 20 amino acids, less than 15 amino acids, less than 10 amino acids, or less than 5 amino acids. Amino acids forming a peptidyl IL-7Rαγc ligand linker can comprise naturally occurring amino acids and/or non-naturally occurring amino acids.

A peptidyl IL-7Rαγc ligand linker can comprise, for example, flexible amino acids such as glycine. Flexible linkers can include small, non-polar amino acids such as glycine or polar amino acids. The small size of these amino acids provides flexibility and allows for mobility of the connecting functional domains. Incorporation of serine or threonine can maintain the stability of the linker in aqueous solutions by forming hydrogen bonds with water molecules, and thereby reduces unfavorable interactions between the linker and protein moieties. Amino acids such as lysine and glutamic acid can be included to improve solubility. The length of a peptidyl IL-7Rαγc linker can be selected to provide a suitable separation between the IL-7Rα and Rγc ligands to favor a desired interaction with IL-7R such as enhancing agonist activity. Examples of flexible linkers include (G)$_n$ (SEQ ID NO: 9380), (GS). (SEQ ID NO: 9381), (GGS)$_n$ (SEQ ID NO: 9382), (GGGS)$_n$ (SEQ ID NO: 9383), (GGGGS)$_n$ (SEQ ID NO: 9384)$_n$, and a combination of any of the foregoing, where n can independently be, for example, an integer from 1 to 20.

A peptidyl IL-7Rαγc ligand linker can be a rigid linker. Rigid linkers can be proline rich and can include other amino acids such as alanine, lysine, and/or glutamic acid. A rigid linker can have the sequence (PX)$_n$ (SEQ ID NO: 9429), where X can be, for example, alanine, lysine, or glutamic acid, and n can be an integer from 1 to 20. Examples of rigid linkers include (PA)$_n$ where n can be, for example, an integer from 1 to 20 (SEQ ID NO: 9421). The value of n can be, for example, greater than 5, greater than 10, greater than 20, greater than 30, greater than 40 or greater than 50.

A peptidyl IL-7Rαγc ligand linker can comprise, for example, G)$_n$ (SEQ ID NO: 9380), (GS)$_n$ (SEQ ID NO: 9381), (GGS)$_n$ (SEQ ID NO: 9382), (GGGS)$_n$ (SEQ ID NO: 9383), (GGGGS)$_n$ (SEQ ID NO: 9384), or combinations of any of the foregoing, where n is independently an integer from 1 to 20. The value of n can be, for example, greater than 5, greater than 10, greater than 20, greater than 30, greater than 40 or greater than 50. For example, a peptidyl ligand linker can be -G-G- (SEQ ID NO: 9399), -G-G-G- (SEQ ID NO: 9400), -G-G-S- (SEQ ID NO: 9402), -G-G-G-S- (SEQ ID NO: 9403), -G-G-G-G-S-G-G- (SEQ ID NO: 9404), or -G-G-S-G-G-S- (SEQ ID NO: 9405). IL-7Rαγc ligands comprising a peptidyl IL-7Rαγc ligand linker can be synthesized using non-recombinant methods such as using the solid phase synthesis as described in Example 1 or can be synthesized using recombinant DNA technology.

An IL-7Rαγc ligand linker can comprise a synthetic chemical IL-7Rαγc ligand linker. A chemical-synthetic IL-7Rαγc ligand linker refers to a linker that is synthesized using chemical methods and can include amino acids or may not include amino acids. A synthetic chemical IL-7Rαγc ligand linker can comprise a triazole moiety.

A synthetic chemical ligand linker can have the structure, for example, of Formula (L1)-(L17) as shown in Table 1.

TABLE 1

IL-7Rαγc chemical linkers.

| Formula No. | Chemical Structure |
|---|---|
| (L1) | 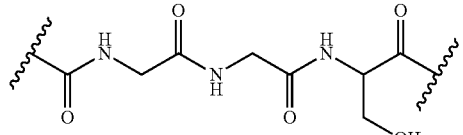 |
| (L2) | 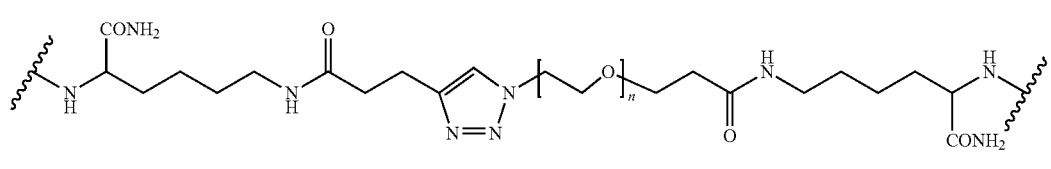 n = 2 |
| (L3) | 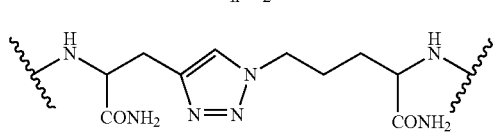 |
| (L4) | 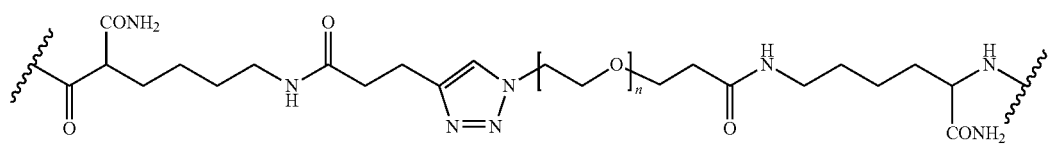 n = 2 |
| (L5) | 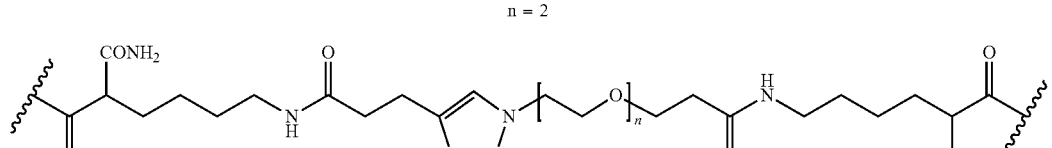 n = 2 |
| (L6) | 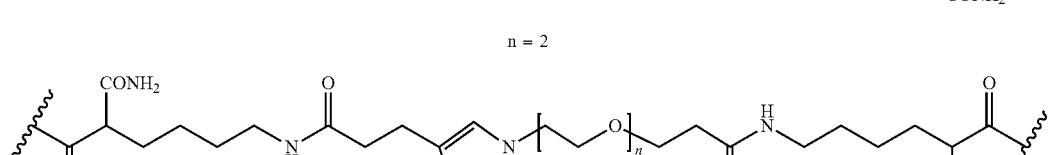 n = 2 |
| (L7) | 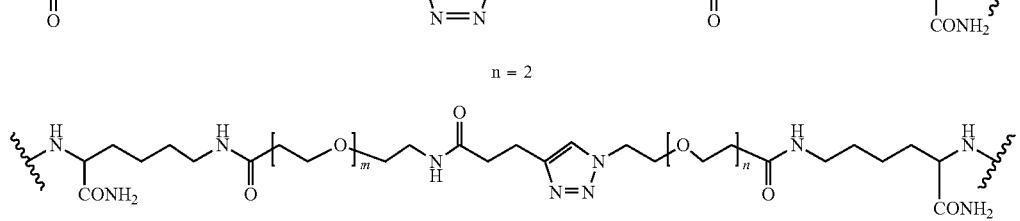 |

TABLE 1-continued

IL-7Rαγc chemical linkers.

| Formula No. | Chemical Structure |
|---|---|
| | M = 4 and n = 2 |
| (L8) | [structure] |
| (L9) | [structure] |
| (L10) | [structure] |
| (L11) | [structure] |
| (L12) | [structure]<br>m = 2, n = 1 |
| (L13) | [structure]<br>m = 2, n = 4 |
| (L14) | [structure] |
| (L15) | [structure] |
| (L16) | [structure] |

TABLE 1-continued

IL-7Rαγc chemical linkers.

| Formula No. | Chemical Structure |
|---|---|
| (L17) | ![structure with ketone, triazole ring, and CONH2 group] |

In IL-7Rαγc ligand linkers (L2), (L4)-(L7), (L12), and L13), m and/or n can be independently an integer, for example, from 1 to 10.

A chemical-synthetic IL-7Rαγc ligand linker can be synthesized using click chemistry to provide IL-7Rαγc ligands having various C/N orientations of the IL-7Rα and Rγc ligands. C/N orientation refers to the terminus of the IL-7Rα and Rγc which are bonded to the IL-7Rαγc ligand linker. For example, for an IL-7Rαγc ligand having a C/N orientation, the C-terminus of the IL-7Rα ligand is bonded to the IL-7Rαγc ligand linker, and the N-terminus of the Rγc ligand is bonded to the IL-7Rαγc ligand linker. As another example, for an IL-7Rαγc ligand having an N/C orientation, the N-terminus of the IL-7Rα ligand is bonded to the IL-7Rαγc ligand linker, and the C-terminus of the Rγc ligand is bonded to the IL-7Rαγc ligand linker.

An example of a synthetic method for preparing an IL-7Rαγc ligand having a synthetic ligand linker is described in Example 2.

IL-7Rα and Rγc ligands can be prepared using standard solid phase peptide synthesis and Fmoc-protected amino acids. A swollen resin can be treated with either an activated solution of Fmoc-propargyl glycine or 2-(Fmoc-NH)-azido-pentanoic acid to provide the corresponding Fmoc-protected resin. The alkyne-containing moiety and the azide-containing moiety can be configured to have, for example, a desired length, rigidity/flexibility, polarity, lipophilicity, and/or steric property. The protected resin can be subjected to repeated cycles of Fmoc-amino acid couplings with HATU activation and Fmoc removal to synthesize the respective IL-7Rα ligand or Rγc ligand. After Fmoc removal from the final amino acid of the IL-7Rα or Rγc ligand, and acylation of terminal amine groups, the ligands can be cleaved from the resin and purified.

The alkyne-containing moiety and azide-containing moiety bonded to an IL-7Rα ligand and a Rγc ligand can be reacted, for example, in the presence of $CuSO_4$ and a metal chelator to provide an IL-7Rαγc ligand comprising a synthetic chemical IL-7Rαγc ligand linker. The reacted alkyne-containing moiety and azide-containing moiety form the chemical ligand linker. For example, referring to Tables 1-3, an alkyne-containing moiety of Formula (AL) in Table 2 can be reacted with an azide-containing moiety of Formula (AZ) in Table 3 to provide a synthetic IL-7Rαγc ligand linker of Formula (L) in Table 1.

Using this click-chemistry method, IL-7Rαγc ligands comprising IL-7Rα and Rγc ligands having differing N-terminal and C-terminal orientations and different ligand linker lengths can be synthesized.

Examples of alkyne-containing moieties are provided in Table 2 and examples of azide-containing moieties are provided in Table 3.

TABLE 2

| Formula No. | Chemical Structure |
|---|---|
| (AL1) | ![structure with NH, CONH2, and terminal alkyne] |
| (AL2) | ![structure with NH, CONH2, and terminal alkyne] |
| (AL3) | ![structure with ketone, CONH2, NH, and terminal alkyne] |
| (AL4) | ![structure with ketone and terminal alkyne] |

Examples of alkyne-containing moieties.

TABLE 2-continued
Examples of alkyne-containing moieties.
| Formula No. | Chemical Structure |
|---|---|
| (AL5) | 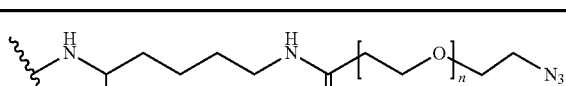 n = 4 |
| (AL6) | m = 2 and n = 1 |
| (AL7) | m = 2 and n = 4 |
| (AL8) | m = 1 to 10, and n = 1 to 10 |
| (AL9) | m = 1 to 10, and n = 1 to 10 |
TABLE 3
Examples of azide-containing moieties.
| Formula No. | Chemical Structure |
|---|---|
| (AZ1) | 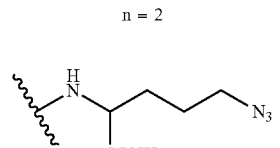 n = 2 |
| (AZ2) | 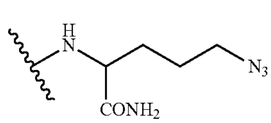 |

TABLE 3-continued

Examples of azide-containing moieties.

| Formula No. | Chemical Structure |
|---|---|
| (AZ3) | <br>n = 1 or 2 |
| (AZ4) | 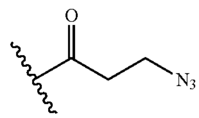 |
| (AZ5) | 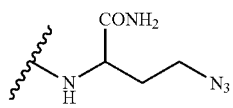 |

An IL-7Rαγc ligand can comprise N- and/or C-terminal modifications to prevent or minimize degradation by aminopeptidases and carboxypeptidases. Examples of terminal groups include an acetyl group on the N-terminus and a carboxamide group on the C-terminus.

IL-7Rαγc ligands provided by the present disclosure can comprise, for example, a moiety having the structure of Formula (4):

-AL-L-GL-    (4)

where AL comprises an IL-7Rα ligand, L comprises an IL-7Rαγc ligand linker, and GL comprises an Rγc ligand.

A moiety of Formula (4) can be terminated in small chemical moieties and can have a molecular weight, for example, less than 12,000 Da, less than 11,000 Da, less than 10,000 Da, less than 9,000 Da, less than 8,000 Da, less than 7,000 Da, less than 6,000 Da, less than 5,000 Da, less than 4,000 Da, less than 3,000 Da, less than 2,000 Da, or less than 1,000 Da. An IL-7Rαγc ligand can have a molecular weight, for example, from 1,000 Da to 12,000 Da, from 2,000 Da, to 11,000 Da, from 3,000 Da, to 10,000 Da, or from 4,000 Da to 9,000 Da.

In IL-7Rαγc ligands of Formula (4), AL can comprise an IL-7Rα ligand having an amino acid sequence of any one of SEQ ID NOS: 389-410, 420-556 and 9434-9437, a truncated amino acid sequence of any one of SEQ ID NOS: 389-410, 420-556 and 9434-9437, or having an amino acid sequence having greater than 60%, greater than 70%, greater than 80%, greater than 85%, greater than 90%, or greater than 95% sequence similarity to any one SEQ ID NOS: 389-410, 420-556 and 9434-9437; GL can comprise an Rγc ligand having an amino acid sequence of any one of SEQ ID NOS: 944-1031 and 9438-9443, or having an amino acid sequence having greater than 60%, greater than 70%, greater than 80%, greater than 85%, greater than 90%, or greater than 95% sequence similarity to any one of SEQ ID NOS: 944-1031 and 9438-9443, and L can comprise a peptidyl IL-7Rαγc ligand linker or a synthetic-chemical IL-7Rαγc ligand linker. Examples of suitable peptidyl IL-7Rαγc ligand linkers are disclosed in FIGS. 14A-14D, and examples of suitable synthetic-chemical ligand linkers are disclosed in FIGS. 13A-13B.

In IL-7Rαγc ligands of Formula (4), either the N-terminus or the C-terminus of the IL-7Rα ligand can be bound to the IL-7Rαγc ligand linker and either the N-terminus or the C-terminus of Rγc ligand can be bound to the IL-7Rαγc ligand linker. For example, the C-terminus of the IL-7Rα ligand (BL) can be bound to the IL-7Rαγc ligand linker (L) and the N-terminus of the Rγc ligand (GL) can be bound to the IL-7Rαγc ligand linker (L).

In IL-7Rαγc ligands of Formula (4) each of the IL-7Rα ligand and the Rγc ligand can comprise one or more flanking amino acids bound to the N-terminus and/or to the C-terminus of the ligand. For example, both the N-terminus and the C-terminus of the IL-7Rα ligand can comprise -(G)$_n$- and both the N-terminus and the C-terminus of the Rγc ligand can comprise -(G)$_n$- where n is an integer from 1 to 10 (SEQ ID NO: 9385), such as from 1 to 8, from 2 to 6, or from 2 to 4. The flanking amino acids can be bound to the IL-7Rαγc ligand linker.

IL-7Rαγc ligands of Formula (4) can comprise an acetyl terminal group on the N-terminus and a carboxamide group on the C-terminus.

An IL-7Rαγc ligand provided by the present disclosure can comprise the structure of Formula (4a):

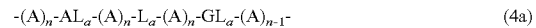    (4a)

where,
each n can be independently an integer from 0 to 10;
AL$_a$ can be an IL-7Rα ligand comprising an amino acid sequence or truncated amino acid sequence selected from any one of SEQ ID NOS: 389-410, 420-556 and 9434-9437, or comprising an amino acid sequence having greater than 60%, greater than 70%, greater than 80%, greater than 85%, or greater than 90% sequence similarity to any one of SEQ ID NOS: 389-410, 420-556 and 9434-9437;
GL$_a$ can be an Rγc ligand comprising an amino acid sequence or a truncated amino acid sequence selected from any one of SEQ ID NOS: 944-1031 and 9438-9443, or comprising an amino acid sequence having greater than 60%, greater than 70%, greater than 80%, greater than 85%, or greater than 90% sequence similarity to any one of SEQ ID NOS: 944-1031 and 9438-9443;

each A can be independently selected from an amino acid; and

L$_a$ can be a peptidyl ligand linker comprising from 1 to 50 amino acids.

In IL-7Rαγc ligands of Formula (4a), the C-terminus of the IL-7Rα ligand can be bound to the peptidyl ligand linker, and the N-terminus of the Rγc ligand can be bound to the peptidyl ligand linker.

In IL-7Rαγc ligands of Formula (4a) each n can independently be selected from, for example, an integer from 0 to 8, from 0 to 6, from 0 to 4, or from 0 to 2. For example, n can be 0, 1, 2, or 3.

Each A can independently be selected from a naturally occurring or non-naturally occurring amino acid. Each A can be independently be selected from a flexible amino acid such as glycine and serine. Each A can be glycine.

L$_a$ can comprise, for example, from 1 to 40 amino acids, from 1 to 30 amino acids, from 1 to 20 amino acids, from 1 to 10 amino acids, or from 1 to 5 amino acids. L$_a$ can be selected from a peptidyl ligand linker. For example, L$_a$ can be (PA)$_n$ (SEQ ID NO: 9323), (G)$_n$ (SEQ ID NO: 9385), (GS). (SEQ ID NO: 9386), (GGS)$_n$ (SEQ ID NO: 9387), (GGGS)$_n$ (SEQ ID NO: 9388), (GGGGS)$_n$ (SEQ ID NO: 9389), or a combination of any of the foregoing, where p can independently be an integer from 1 to 10.

Examples of IL-7Rαγc ligands comprising a chemical IL-7Rαγc ligand linker are listed in FIGS. 13A-13D.

Examples of IL-7Rαγc ligands comprising a peptidyl IL-7Rαγc ligand linker are listed in FIGS. 14A-14D.

IL-7Rαγc ligands provided by the present disclosure can comprise disulfide bonds. IL-7Rα ligands and Rγc ligands can comprise at least two cysteines. The at least two cysteines of an IL-7Rα ligand can be bound to another cysteine through a disulfide bond and each of the at least two cysteines of an Rγc ligand can be bound to a cysteine through a disulfide bond.

In an IL-7Rαγc ligand, two cysteines of the IL-7Rα ligand can be bound together through a disulfide bond and/or two cysteines of the Rγc ligand can be bound together through a disulfide bond. In an IL-7Rαγc ligand a cysteine of an IL-7Rα ligand can be bound to a cysteine of an Rγc ligand through a disulfide bond, or each of the two cysteines of an IL-7Rα ligand can be bound to a cysteine of an Rγc ligand. For example, in an IL-7Rαγc ligand having the structure (5):

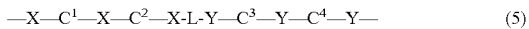

$$-X-C^1-X-C^2-X-L-Y-C^3-Y-C^4-Y- \quad (5)$$

where —X—C$^1$—X—C$^2$—X-represents an amino acid sequence of an IL-7Rα ligand having two cysteines, C$^1$ and C$^2$, such as any one of SEQ ID NOS: SEQ ID NOS: 389-410, 420-556 and 9434-9437, and where each X is independently one or more amino acids; —Y—C$^3$—Y—C$^4$—Y— represents an amino acid sequence of an Rγc ligand having two cysteines, C$^3$ and C$^4$, such as any one of SEQ ID NOS: 944-1031 and 9438-9443, and where each Y is independently one or more amino acids, and -L- is an IL-7Rαγc ligand linker coupling the IL-7Rα ligand and the Rγc ligand.

In an IL-7Rαγc ligand of Formula (5), C$^1$ can be bound to C$^2$ and C$^3$ can be bound to C$^4$ through disulfide bonds; C$^1$ can be bound to C$^3$ and C$^2$ can be bound to C$^4$ through disulfide bonds, or C$^1$ can be bound to C$^4$ and C$^2$ can be bound to C$^3$ through disulfide bonds.

IL-7Rαγc ligands that contain more than 2 cysteines can have a preferred pattern of Cys-Cys bonds (disulfide bridges) that exhibit the greatest activity such as, for example, Cys 1-2, and Cys 3-4, and other disulfide patterns can exhibit desired activity and have useful properties IL-7Rαγc ligands provided by the present disclosure can comprise an IL-7Rα ligand having SEQ ID NOS: 410 or 420-461, a truncated amino acid sequence of SEQ ID NO: 410 or 420-461, or an amino acid sequence having greater than 60%, greater than 70%, greater than 75%, greater than 80%, greater than 85%, greater than 90%, or greater than 95% sequence similarity to SEQ ID NO: 410 or 420-461; and an Rγc ligand having SEQ ID NO: 965 or 1029-1031, a truncated amino acid sequence of SEQ ID NO: 965 or 1029-1031, or an amino acid sequence having greater than 60%, greater than 70%, greater than 75%, greater than 80%, greater than 85%, greater than 90%, or greater than 95% sequence similarity to SEQ ID NO: 965 or 1029-1031.

In IL-7Rαγc ligands the C-terminus of the IL-7Rα ligand can be linked to the N-terminus of the Rγc ligand.

An IL-7Rαγc ligand can comprise an IL-7Rα ligand having greater than 70%, greater than 80% or greater than 90% amino acid sequence similarity to SEQ ID NO: 410 or 420-461, and an Rγc ligand having greater than 70%, greater than 80% or greater than 90% amino acid sequence similarity to SEQ ID NO: 965 or 1029-1031.

Each of the IL-7Rα ligand and the Rγc ligand can independently comprise one or more flanking amino acids such as one or more glycines. For example, each of the N-terminus and the C-terminus of the IL-7Rα ligand and the Rγc ligand can independently comprise glycines.

The N-terminus of the IL-7Rα ligand can be coupled to the C-terminus of the Rγc ligand through a flexible linker comprising, for example, from 1 to 50 amino acids, from 1 to 40, from 1 to 30, from 1 to 20, from 1 to 10, or from 1 to 5. A flexible linker can comprise, for example, greater than 5 amino acids, greater than 10, greater than 20, greater than 30, greater than 40, or greater than 50 amino acids. The linker can be, for example, (G). (SEQ ID NO: 9390), (GS). (SEQ ID NO: 9391), (GGS). (SEQ ID NO: 9392), (GGGS). (SEQ ID NO: 9393), (GGGGS). (SEQ ID NO: 9394), or a combination of any of the foregoing, where n can independently be an integer from 1 to 5. For example, the linker can be GGGGS (SEQ ID NO: 9395) or GGGGSGG (SEQ ID NO: 9404).

An IL-7Rαγc ligand can comprise the amino acid sequence of SEQ ID NO: 2012 (-VHRIPWCTLDPGGLQ-CAWLRQMGGGGSGGVVCQDWEGVELCWQ-), or an amino acid sequence having greater than 60%, greater than 70%, greater than 75%, greater than 80%, greater than 85%, greater than 90%, or greater than 95% sequence similarity to SEQ ID NO: 2012.

An IL-7Rαγc ligand can comprise the amino acid sequence of SEQ ID NO: 2058 (-VHRIPWCTLDPGGLQ-CAWLRQM-X$^{300}$-GGVVCQDWEGVELCWQ-) or can comprise an amino acid sequence having greater than 60%, greater than 70%, greater than 80%, greater than 85%, greater than 90%, or greater than 95% amino acid sequence similarity to SEQ ID NO: 2058, where X$^{300}$ can include from 1 to 20 amino acids. For example, X$^{300}$ can be selected from (G). (SEQ ID NO: 9390), (GS). (SEQ ID NO: 9391), (GGS). (SEQ ID NO: 9392), (GGGS). (SEQ ID NO: 9393), (GGGGS). (SEQ ID NO: 9394) or a combination of any of the foregoing, where n can independently be an integer from 1 to 5. For example, X$^{300}$ can be selected from (P). (SEQ ID NO: 9420) or (PA)$_n$ (SEQ ID NO: 9421) where n is an integer from 1 to 20. X$^{300}$ can comprise, for example, (PX). (SEQ ID NO: 9429) where each X can independently be selected from alanine, lysine, or glutamic acid, and n can be an integer from 1 to 20. $X^{300}$ can be $(PA)_n$ where n can be, for example, an integer from 1 to 10 (SEQ ID NO: 9423).

An IL-7Rαγc ligand can comprise the amino acid sequence of SEQ ID NO: 2059 (-VHRIPWCTLDPGGLQ-CAWLRQM-$X^{301}$-VVCQDWEGVELCWQ-) or an amino acid sequence having greater 60%, greater than 70%, greater than 80%, greater than 85%, greater than 90%, or greater than 95% amino acid sequence similarity to SEQ ID NO: 2059, where $X^{30}$1 includes from 1 to 20 amino acids. For example, $X^{30}$1 can be selected from (G). (SEQ ID NO: 9390), (GS). (SEQ ID NO: 9391), (GGS). (SEQ ID NO: 9392), (GGGS). (SEQ ID NO: 9393), (GGGGS). (SEQ ID NO: 9394) or a combination of any of the foregoing, where n can independently be an integer from 1 to 5.

In IL-7Rαγc ligands of any one of SEQ ID NOS: 2012-2023 and 2058-2059 or an amino acid sequence having greater than 60%, greater than 70%, greater than 75%, greater than 80%, greater than 85%, greater than 90%, or greater than 95% sequence similarity to any one of SEQ ID NOS: 2012-2023 and 2058-2059, the cysteines of the IL-7Rα ligand can be bound together through a disulfide bond, and the cysteines of the Rγc ligand can be bound together through a disulfide bond. In certain IL-7Rαγc ligands, the cysteines of the IL-7Rα ligand can be bound to the cysteines of the Rγc ligand.

Figure 7:
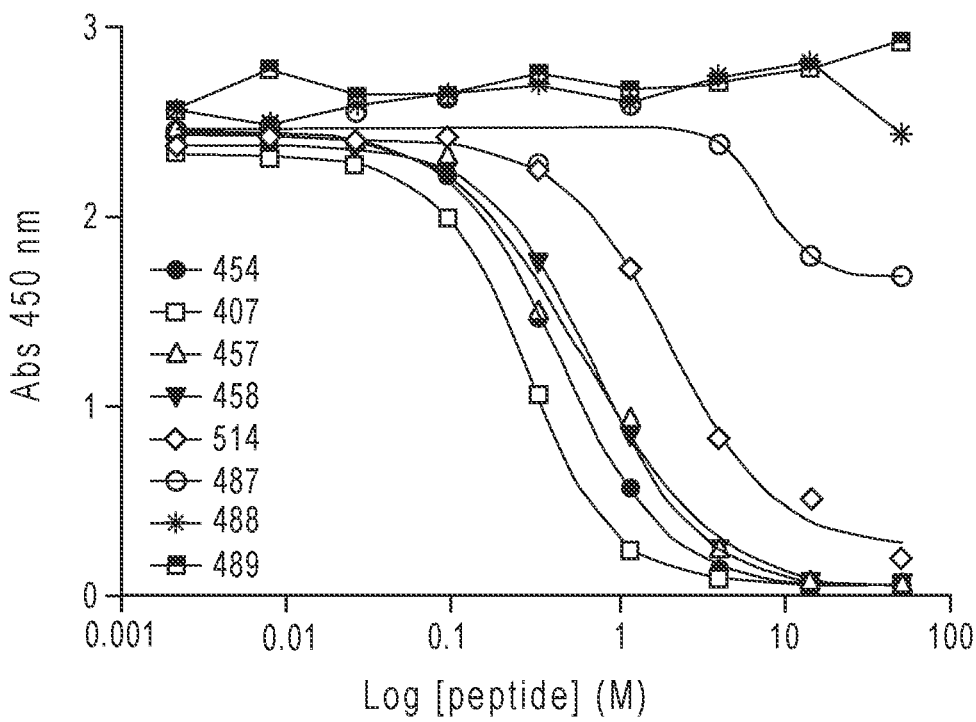
FIG. 7 shows the normalized ELISA signal for competitive binding of the NA-HRP complexes of various C-terminal truncated and biotinylated IL-7Rα ligands based on SEQ ID NO: 407 to the IL-7Rα subunit.
Figure 8:
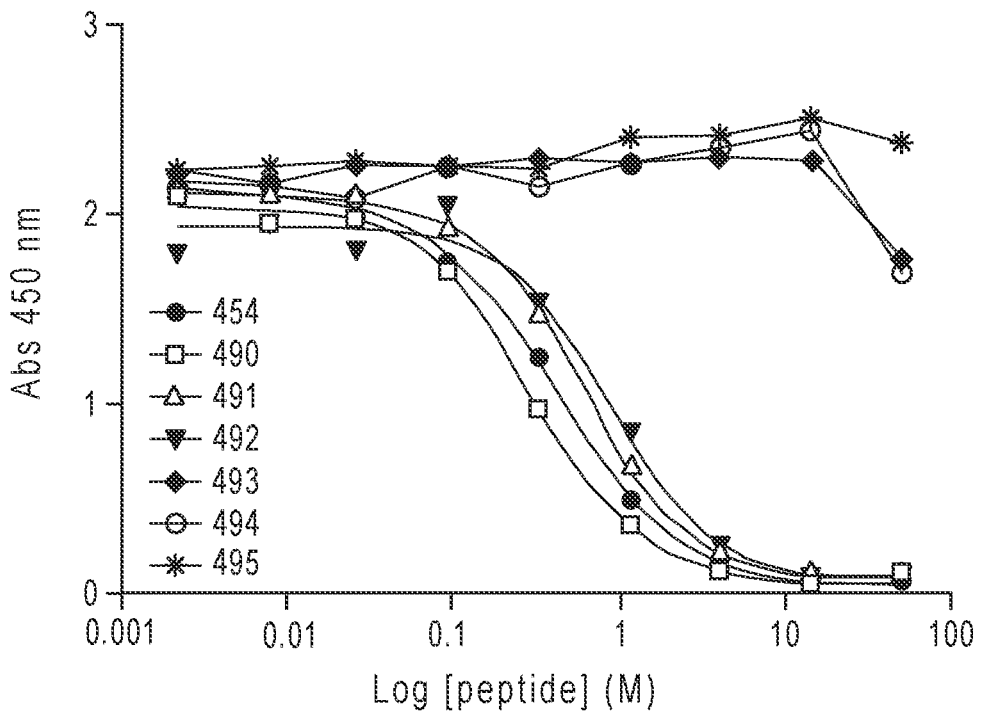
FIG. 8 shows the normalized ELISA signal for competitive binding of the NA-HRP complexes of various N-terminal truncated and biotinylated IL-7Rα ligands based on SEQ ID NO: 407 to the IL-7Rα subunit.

The results of ELISA competition assays with the truncated IL-7Rα ligands having SEQ ID NOS: 407, 454 and 457 based on the IL-7Rα ligand having SEQ ID NO: 454 and a biotinylated peptide::NA-HRP complex are shown in FIG. 7 for the C-terminus truncations and in FIG. 8 for the N-terminus truncations.

An IL-7Rαγc ligand provided by the present disclosure can comprise an amino acid sequence selected from any one of SEQ ID NO: 2064-2073:

```
                                   SEQ ID NO: 2064
VHRIPWCTLDPGGLQCAWLRQMGGGGSGGVVCQDWEGVELCWQPPA

SEQ ID NO: 2065
VHRIPWCTLDPGGLQCAWLRQGGGGSGGVVCQDWEGVELCWQPPA

SEQ ID NO: 2066
VHRIPWCTLDPGGLQCAWLRGGGGSGGVVCQDWEGVELCWQPPA

SEQ ID NO: 2067
GWGIPWCTLDPGSLQCAWLGKHGGGGSGGVVCQDWEGVELCWQPPA

SEQ ID NO: 2068
VHRIPWCTLDPGGLQCAWLRQGGGGGSGGVVCQDWEGVELCWQPPA

SEQ ID NO: 2069
VHRIPWCTLDPGGLQCAWLRGGGGGSGGVVCQDWEGVELCWQPPA

SEQ ID NO: 2070
VHRIPWCTLDPGGLQCAWLRQGGGGSGGVVCQDWEGVELCWQGG

SEQ ID NO: 2071
VHRIPWCTLDPGGLQCAWLRGGGGSGGVVCQDWEGVELCWQGG

SEQ ID NO: 2072
GWGIPWCTLDPGSLQCAWLGKHGGGGSGGVVCQDWEGVELCWQGG

SEQ ID NO: 2073
VHRIPWCTLDPGGLQCAWLRQM(PA)₈GVVCQDWEGVELCWQGG
```

An IL-7Rαγc ligand can comprise an amino acid sequence selected from any one of SEQ ID NO: 2060-2063 and 2074-2094:

```
                                   SEQ ID NO: 2060
IEGRGGQCIHWDIETLLSCVGGGGSGGVVCQDWEGVELCWQ

SEQ ID NO: 2061
IEGRGGVPWCTLDPGSLQCAWFGGGGSGGVVCQDWEGVELCWQ

SEQ ID NO: 2062
IEGRGGRYECADLPGGLHCEFRGGGGSGGVVCQDWEGVELCWQ

SEQ ID NO: 2063
RHFDDIIPWCTLDPGSLQCAYLGGGGSGGVVCQDWEGVELCWQ

SEQ ID NO: 2074
HLGVPWCTLDPGSIQCAWLAKHGGGGSGGVVCQDWEGVELCWQ

SEQ ID NO: 2075
VVCQDWEGVELCWQGGGGSGGRHFDDIIPWCTLDPGSLQCAYL

SEQ ID NO: 2076
VVCQDWEGVELCWQGGGGSGGHLGVPWCTLDPGSIQCAWLAKH

SEQ ID NO: 2012
VHRIPWCTLDPGGLQCAWLRQMGGGGSGGVVCQDWEGVELCWQ

SEQ ID NO: 2077
HCKHWDLESLLLCVGGGGSGGVVCQDWEGVELCWQ

SEQ ID NO: 2078
QCVHWDLDTLFGCIREQLELGGGGSGGVVCQDWEGVELCWQ

SEQ ID NO: 2079
VVCQDWEGVELCWQGGGGSGGQCVHWDLDTLFGCIREQLEL

SEQ ID NO: 2080
IRSCLWQPGALHCTWWAEEEPVGGGGSGGVVCQDWEGVELCWQ

SEQ ID NO: 2081
VVCQDWEGVELCWQGGGGSGGIRSCLWQPGALHCTWWAEEEPV

SEQ ID NO: 2082
IPWCLLDPGGLQCVWLGGGGSGGVVCQDWEGVELCWQ

SEQ ID NO: 2083
VVCQDWEGVELCWQGGGGSGGIPWCLLDPGGLQCVWL

SEQ ID NO: 2084
VHRIPWCTLDPGGLQCAWLRQMGGGGSGGVVCQDWEGVELCWQG

SEQ ID NO: 2085
VHRIPWCTLDPGGLQCAWLRQMGGGGSGGVVCQDWEGVELCWQGG

SEQ ID NO: 2086
GVHRIPWCTLDPGGLQCAWLRQMGGGGSGGVVCQDWEGVELCWQGG

SEQ ID NO: 2087
GGVHRIPWCTLDPGGLQCAWLRQMGGGGSGGVVCQDWEGVELCWQGG

SEQ ID NO: 2088
VHRIPWCTLDPGGLQCAWLRGGGGSGGVVCQDWEGVELCWQ

SEQ ID NO: 2089
WGIPWCTLDPGSLQCAWLGKHGGGGSGGVVCQDWEGVELCWQ

SEQ ID NO: 2090
VHRIPWCTLDPGGLQCAWLRQGGGGSGGVVCQDWEGVELCWQ

SEQ ID NO: 2091
VHRIPWCTLDPGGLQCAWLRMGGGGSGGVVCQDWEGVELCWQ

SEQ ID NO: 2092
VHRIPWCTLDPGGLQCAWIRQMGGGGSGGVVCQDWEGVELCWQ

SEQ ID NO: 2093
VHRIPWCTLDPGGLQCAWVRQMGGGGSGGVVCQDWEGVELCWQ

SEQ ID NO: 2094
VHRIPWCTLDPGGLQCAWARQMGGGGSGGVVCQDWEGVELCWQ
```

An IL-7Rαγc ligand can comprise an amino acid sequence selected from any one of SEQ ID NO: 2095-2109:

```
                                        SEQ ID NO: 2095
GVHRIPWCTLDPGGLQCAWLRQMGGGGSGGVVCQDWEGVELCWQG

SEQ ID NO: 2096
VHRIPWCTLDPGGLQCAWLRQGGGGSGGVVCQDEGVELCWQ

SEQ ID NO: 2097
VHRIPWCTLDPGGLQCAWLRGGGGSGGVVCQDWGVELCWQ

SEQ ID NO: 2098
VHRIPWCTLDPGGLQCAWLGKHGGGGSGGVVCQWEGVELCWQ

SEQ ID NO: 2099
VHRIPWCTLDPGGLQCAWLRMGGGGSGGVVCQDWGVELCWQ

SEQ ID NO: 2100
GWGIPWCTLDPGGLQCAWLRQMGGGGSGGVVCQDWEGVELCWQ

SEQ ID NO: 2101
GWGIPWCTLDPGGLQCAWLRQGGGGSGGVVCQDEGVELCWQ

SEQ ID NO: 2102
GWGIPWCTLDPGGLQCAWLRGGGGSGGVVCQDWGVELCWQ

SEQ ID NO: 2103
GWGIPWCTLDPGGLQCAWLGKHGGGGSGGVVCQWEGVELCWQ

SEQ ID NO: 2104
GWGIPWCTLDPGGLQCAWLRMGGGGSGGVVCQDWGVELCWQ

SEQ ID NO: 2105
IPWCTLDPGGLQCAWLRQMGGGGSGGVVCQDWEGVELCWQ

SEQ ID NO: 2106
IPWCTLDPGGLQCAWLRQGGGGSGGVVCQDEGVELCWQ

SEQ ID NO: 2107
IPWCTLDPGGLQCAWLRGGGGSGGVVCQDWGVELCWQ

SEQ ID NO: 2108
IPWCTLDPGGLQCAWLGKHGGGGSGGVVCQWEGVELCWQ

SEQ ID NO: 2109
IPWCTLDPGGLQCAWLRMGGGGSGGVVCQDWGVELCWQ
```

An IL-7Rαγc ligand provided by the present disclosure can comprise a truncated amino acid sequence of any one of SEQ ID NOS: 2060-2109.

An IL-7Rαγc ligand provided by the present disclosure can comprise an amino acid sequence selected from any one of SEQ ID NOS: 2060-2109, or a truncated amino acid sequence of any one of SEQ ID NOS: 2060-2109, wherein the amino acid sequence can independently comprise from 1 to 4 glycines (G) (SEQ ID NO: 2045) on the N-terminus, on the C-terminus, or on both the N- and C-termini.

An IL-7Rαγc ligand provided by the present disclosure can comprise an amino acid sequence selected from any one of SEQ ID NOS: 2060-2109, or a truncated amino acid sequence of any one of SEQ ID NOS: 2060-2109, wherein the amino acid sequence comprises one or more amino acid substitutions such as from 1 to 5 amino acid substitutions. An amino acid substitution can be a conservative amino acid substitution.

An IL-7Rαγc ligands of SEQ ID NOS: 2060-2109 can bind to the human Rγc subunit with an $IC_{50}$ of less than 100 μM.

An IL-7Rαγc ligand can comprise an amino acid sequence having an amino acid similarity greater than 60%, greater than 70%, greater than 75%, greater than 80%, greater than 85%, greater than 90%, or greater than 95% to the amino acid sequence of any one of SEQ ID NOS: 2060-2109.

An Rγc ligand can comprise an amino acid sequence having an amino acid sequence similarity greater than 60%, greater than 70%, greater than 75%, greater than 80%, greater than 85%, greater than 90%, or greater than 95%, to the amino acid sequence of any one of SEQ ID NOS: 2060-2109.

An IL-7Rαγc ligand can comprise an amino acid sequence selected from any one of SEQ ID NO: 2110-2124:

```
                                        SEQ ID NO: 2110
VHRIPWCTLDPGGLQCAWLRQM-X400-VVCQDWEGVELCWQ

SEQ ID NO: 2111
VHRIPWCTLDPGGLQCAWLRQ-X400-VVCQDEGVELCWQ

SEQ ID NO: 2112
VHRIPWCTLDPGGLQCAWLR-X400-VVCQDWGVELCWQ

SEQ ID NO: 2113
VHRIPWCTLDPGGLQCAWLGKH-X400-VVCQWEGVELCWQ

SEQ ID NO: 2114
VHRIPWCTLDPGGLQCAWLRM-X400-VVCQDWGVELCWQ

SEQ ID NO: 2115
GWGIPWCTLDPGGLQCAWLRQM-X400-VVCQDWEGVELCWQ

SEQ ID NO: 2116
GWGIPWCTLDPGGLQCAWLRQ-X400-VVCQDEGVELCWQ

SEQ ID NO: 2117
GWGIPWCTLDPGGLQCAWLR-X400-VVCQDWGVELCWQ

SEQ ID NO: 2118
GWGIPWCTLDPGGLQCAWLGKH-X400-VVCQWEGVELCWQ

SEQ ID NO: 2119
GWGIPWCTLDPGGLQCAWLRM-X400-VVCQDWGVELCWQ

SEQ ID NO: 2120
IPWCTLDPGGLQCAWLRQM-X400-VVCQDWEGVELCWQ

SEQ ID NO: 2121
IPWCTLDPGGLQCAWLRQ-X400-VVCQDEGVELCWQ

SEQ ID NO: 2122
IPWCTLDPGGLQCAWLR-X400-VVCQDWGVELCWQ

SEQ ID NO: 2123
IPWCTLDPGGLQCAWLGKH-X400-VVCQWEGVELCWQ

SEQ ID NO: 2124
IPWCTLDPGGLQCAWLRM-X400-VVCQDWGVELCWQ
```

In an IL-7Rαγc ligand of any one of SEQ ID NOS: 2110-2124, $X^{400}$ can be selected from, FOR example, $(G)_n$ (SEQ ID NO: 9390), (GS). (SEQ ID NO: 9391), $(GGS)_n$ (SEQ ID NO: 9392), $(GGGS)_n$ (SEQ ID NO: 9393), $(GGGGS)_n$ (SEQ ID NO: 9394) or a combination of any of the foregoing, where n can independently be an integer from 1 to 5.

In an IL-7Rαγc ligand of any one of 2110-2124, $X^{400}$ can be -GGGGSGG- (SEQ ID NO: 9404).

In an IL-7Rαγc ligand of any one of SEQ ID NO: 2110-2124, the ligand can comprise flanking glycines on each terminus such as two flanking glycines on one or both termini.

An IL-7Rαγc ligand provided by the present disclosure can comprise a truncated amino acid sequence of any one of SEQ ID NOS: 2110-2124.

An IL-7Rαγc ligand provided by the present disclosure can comprise an amino acid sequence selected from any one of SEQ ID NOS: 2110-2124, or a truncated amino acid sequence of any one of SEQ ID NOS: 2110-2124, wherein the amino acid sequence can independently comprise from 1 to 4 glycines (G) (SEQ ID NO: 2045) on the N-terminus, on the C-terminus, or on both the N- and C-termini.

An IL-7Rαγc ligand provided by the present disclosure can comprise an amino acid sequence selected from any one of SEQ ID NOS: 2110-2124, or a truncated amino acid sequence of any one of SEQ ID NOS: 2110-2124, wherein the amino acid sequence comprises one or more amino acid substitutions such as from 1 to 5 amino acid substitutions. An amino acid substitution can be a conservative amino acid substitution.

An IL-7Rαγc ligands of SEQ ID NOS: 2110-2124 can bind to the human Rγc subunit with an $IC_{50}$ of less than 100 µM.

An IL-7Rαγc ligand can comprise an amino acid sequence having an amino acid similarity greater than 60%, greater than 70%, greater than 75%, greater than 80%, greater than 85%, greater than 90%, or greater than 95% to the amino acid sequence of any one of SEQ ID NOS: 2110-2124. An Rγc ligand can comprise an amino acid sequence having an amino acid sequence similarity greater than 60%, greater than 70%, greater than 75%, greater than 80%, greater than 85%, greater than 90%, or greater than 95%, to the amino acid sequence of any one of SEQ ID NOS: 2110-2124.

An IL-7Rαγc ligand can be selected from a peptide having the amino acid sequence of any one of an amino acid sequence of Formula (6) (SEQ ID NO: 2125), an amino acid sequence of Formula (6a) (SEQ ID NO: 2126), an amino acid sequence of Formula (6b) (SEQ ID NO: 2127), an amino acid sequence of Formula (6c) (SEQ ID NO: 2128), an amino acid sequence of Formula (6d) (SEQ ID NO: 2129), an amino acid sequence of Formula (6e) (SEQ ID NO: 2130), an amino acid sequence of Formula (6f) (SEQ ID NO: 2131), an amino acid sequence of Formula (6g) (SEQ ID NO: 2132), a truncated an amino acid sequence of any one Formula (6)-(6g), an amino acid sequence having greater than 80% sequence similarity to any one of Formula (6)-(6g), or a combination of any of the foregoing:

(6)
$-X^{198}-X^{199}-X^{200}$-I-P-W-C-T-L-D-P-G-$X^{210}$-L-Q-C-A-W-L-$X^{217}$-$X^{218}$-$X^{219}$-$X^{400}$-VVCQDWEGVELCWQ- (6a)
$-X^{199}-X^{200}$-I-P-W-C-T-L-D-P-G-$X^{210}$-L-Q-C-A-W-L-$X^{217}$-$X^{218}$-$X^{219}$-$X^{400}$-VVCQDWEGVELCWQ- (6b)
$-X^{200}$-I-P-W-C-T-L-D-P-G-$X^{210}$-L-Q-C-A-W-L-$X^{217}$-$X^{218}$-$X^{219}$-$X^{400}$-VVCQDWEGVELCWQ- (6c)
-I-P-W-C-T-L-D-P-G-$X^{210}$-L-Q-C-A-W-L-$X^{217}$-$X^{218}$-$X^{219}$-$X^{400}$-VVCQDWEGVELCWQ- (6d)
$-X^{198}-X^{199}-X^{200}$-I-P-W-C-T-L-D-P-G-$X^{210}$-L-Q-C-A-W-L-$X^{217}$-$X^{218}$-$X^{400}$-VVCQDWEGVELCWQ- (6e)
$-X^{198}-X^{199}-X^{200}$-I-P-W-C-T-L-D-P-G-$X^{210}$-L-Q-C-A-W-L-$X^{217}$-$X^{400}$-VVCQDWEGVELCWQ- (6f)
$-X^{198}-X^{199}-X^{200}$-I-P-W-C-T-L-D-P-G-$X^{210}$-L-Q-C-A-W-L-$X^{400}$-VVCQDWEGVELCWQ- (6g)
$-X^{198}-X^{199}-X^{200}$-I-P-W-C-T-L-D-P-$X^{210}$-L-Q-C-A-W-L-$X^{400}$-VVCQDWEGVELCWQwherein,
$X^{198}$ is selected from A, G, P, S, T, and V;
$X^{199}$ is selected from F, H, W, and Y;
$X^{200}$ is selected from A, G, H, K, P, R, S, and T;
$X^{210}$ is selected form A, G, P, S, and T;
$X^{217}$ is selected from A, G, H, K, P, R, S, and T;
$X^{218}$ is selected from an amino acid and a single bond;
$X^{219}$ is selected from an amino acid and a single bond; and
$X^{400}$ is selected from $(G)_n$ (SEQ ID NO: 9390), $(GS)_n$ (SEQ ID NO: 9391), $(GGS)_n$ (SEQ ID NO: 9392), $(GGGS)_n$ (SEQ ID NO: 9393), $(GGGGS)_n$ (SEQ ID NO: 9394) or a combination of any of the foregoing, where n is an integer from 1 to 5.

In an IL-7Rαγc ligand of any one of Formula (6)-(6g), 
$X^{198}$ is selected from V and G;
$X^{199}$ is selected from H and W;
$X^{200}$ is selected from R and G;
$X^{210}$ is selected form G and S;
$X^{217}$ is selected from R and G;
$X^{218}$ is selected from Q, G, K and a single bond; and
$X^{219}$ is selected from G, H, M, and a single bond.

In an IL-7Rαγc ligand of any one of Formula (6)-(4g), $X^{198}$ can be V, $X^{199}$ can be H, and $X^{200}$ can be R.

In an IL-7Rαγc ligand of any one of Formula (6)-(6g), $X^{198}$ can be G, $X^{199}$ can be W, and $X^{200}$ can be G In an IL-7Rαγc ligand of any one of Formula (6)-(6g), $X^{210}$ can be G.

In an IL-7Rαγc ligand of any one of Formula (6)-(6g), $X^{210}$ can be S.

In an IL-7Rαγc ligand of any one of Formula (6)-(6g) $X^{217}$ can be R.

In an IL-7Rαγc ligand of any one of Formula (6)-(6g), $X^{217}$ can be R, $X^{218}$ can be Q, and $X^{219}$ can be M.

In an IL-7Rαγc ligand of any one of Formula (6)-(6g), $X^{217}$ can be G, $X^{218}$ can be K, and $X^{219}$ can be H.

In an IL-7Rαγc ligand of any one of Formula (6)-(6g), the IL-7Rα ligand can be defined by any combination of variables as defined in the immediately preceding nine (9) paragraphs.

In an IL-7Rαγc ligand of any one of 2125-2139, $X^{400}$ can be -GGGGSGG- (SEQ ID NO: 9404).

In an IL-7Rαγc ligand of any one of SEQ ID NO: 2125-2132, the ligand can comprise flanking glycines on each terminus such as two flanking glycines on each terminus.

An IL-7Rαγc ligand provided by the present disclosure can comprise a truncated amino acid sequence of any one of SEQ ID NOS: 2125-2132.

An IL-7Rαγc ligand provided by the present disclosure can comprise an amino acid sequence selected from any one of SEQ ID NOS: 2125-2132, or a truncated amino acid sequence of any one of SEQ ID NOS: 2070-2090, wherein the amino acid sequence can independently comprise from 1 to 4 glycines (G) (SEQ ID NO: 2045) on the N-terminus, on the C-terminus, or on both the N- and C-termini.

An IL-7Rαγc ligand provided by the present disclosure can comprise an amino acid sequence selected from any one of SEQ ID NOS: 2125-2132, or a truncated amino acid sequence of any one of SEQ ID NOS: 2070-2095, wherein the amino acid sequence comprises one or more amino acid substitutions such as from 1 to 5 amino acid substitutions. An amino acid substitution can be a conservative amino acid substitution.

An IL-7Rαγc ligand of SEQ ID NOS: 2125-2132 can bind to the human Rγc subunit with an $IC_{50}$ of less than 100 µM.

An IL-7Rαγc ligand can comprise an amino acid sequence having an amino acid similarity greater than 60%, greater than 70%, greater than 75%, greater than 80%, greater than 85%, greater than 90%, or greater than 95% to the amino acid sequence of any one of SEQ ID NOS: 2125-2132.

An IL-7Rαγc ligand provided by the present disclosure can bind to IL-7R such as human IL-7R with an $IC_{50}$ from 1 pM to 100 µM, from 10 µM to 10 µM, from 100 pM to 1 µM, from 0.001 µM to 1 µM, or from 0.01 µM to 1 µM.

An IL-7Rαγc ligand provided by the present disclosure can bind to IL-7R such as human IL-7R with an $IC_{50}$ of less than 100 µM, less than 10 µm, less than 1 µm, less than 100 pM, less than 10 µM, or less than 1 µM.

An IL-7Rαγc ligand provided by the present disclosure can bind to each of the IL-7Rα subunit and to the Rγc subunit, such as each of the human IL-7Rα subunit and the human Rγc subunit, with an $IC_{50}$ from 1 µM to 100 µM, from 10 pM to 10 µM, from 100 pM to 1 µM, from 0.001 µM to 1 µM, or from 0.01 µM to 1 µM.

An IL-7Rαγc ligand provided by the present disclosure can bind to each of the IL-7Rα subunit and the Rγc subunit, such as each of the human IL-7Rα subunit and to the human Rγc subunit with an $IC_{50}$ of less than 100 µm, less than 10 µm, less than 1 µm, less than 100 pM, less than 10 pM, or less than 1 µM.

An IL-7Rαγc ligand provided by the present disclosure can exhibit an $EC_{50}$ for STAT5 phosphorylation in TF-1-7α cells, for example, of less than 100 µM, less than 10 µM, less than 1 µM, less than 100 pM, less than 10 pM, or less than 1 pM.

An IL-7Rαγc ligand provided by the present disclosure can exhibit an $EC_{50}$ for STAT5 phosphorylation in TF-1-7α cells, for example, from 1 pM to 100 µM, from 10 µM to 10 µM, from 100 µM to 1 µM, from 0.001 µM to 1 µM, or from 0.01 µM to 1 µM.

Tandem IL-7Rαγc ligands provided by the present disclosure can comprise two or more IL-7Rαγc ligands. The two or more IL-7Rαγc ligands can be bound together to form a linear or non-linear structure. For example, a tandem IL-7Rαγc ligand can have the structure of Formula (7a) or Formula (7b):

$$AGL\text{-}(\text{-}L_{t1}\text{-}AGL\text{-})_{n1}\text{-}L_{t1}\text{-}AGL \qquad (7a)$$

$$L_{t2}\{(\text{-}L_{t1}\text{-}AGL\text{-})_{n2}\text{-}L_{t1}\text{-}AGL\}_{p} \qquad (7b)$$

where,
each AGL can independently be selected from an IL-7Rαγc ligand;
$L_{t1}$ can be a divalent tandem linker;
$L_{t2}$ can be a p-valent tandem linker;
n1 can be an integer from 1 to 6;
n2 can be an integer from 0 to 6; and
p can be an integer from 3 to 8.

In tandem IL-7Rαγc ligands of Formula (7a) and (7b), each IL-7Rαγc ligand can be the same.

In tandem IL-7Rαγc ligands of Formula (7a) and (7b), at least one IL-7Rαγc ligand can be different than another IL-7Rαγc ligand.

In tandem IL-7Rαγc ligands of Formula (7a) and (7b), each IL-7Rαγc ligand can independently be bound to a tandem linker through the N-terminus or through the C-terminus of the respective IL-7Rαγc ligand.

In tandem IL-7Rαγc ligands of Formula (7a) and (7b), each of the IL-7Rαγc ligands can comprise one or more flanking amino acids.

A tandem linker, $L_{t1}$ and $L_{t2}$, can be a peptidyl tandem linker and can have, for example, from 1 to 50 amino acids, from 2 to 40 amino acids, or from 5 to 30 amino acids.

A tandem linker can comprise a chemical linker such as a triazole-containing linker provided by the present disclosure.

Each divalent tandem linker $L_{t1}$ can be the same as each of the other divalent tandem linkers, or at least one of the divalent tandem linkers can be different than another tandem linker.

In a tandem IL-7Rαγc ligand of Formula (7a), n can be, for example, 1, 2, 3, 4, 5, or 6.

In a tandem IL-7Rαγc ligand of Formula (7b), each n can independently be selected from 0, 1, 2, 3, 4, 5, or 6.

In a tandem IL-7Rαγc ligand of Formula (7b), p can be, for example, 3, 4, 5, 6, 7, or 8.

A p-valent tandem linker can comprise any suitable polyfunctional chemical moiety. For example, tandem IL-7Rαγc ligands of Formula (7a) and (7b) can have a molecular weight less than 10,000 Da, less than 6,000 Da, less than 2,000 Da, less than 1,000 Da, or less than 500 Da.

An IL-7Rαγc ligand provided by the present disclosure can be bound to a naturally occurring protein or to a synthetic molecule to provide an IL-7Rαγc ligand construct. Examples of suitable construct partners include polymers, proteins, Fc-fragments, immunoglobulin fragments, and antibodies.

An IL-7Rαγc ligand construct can be configured to provide desired pharmacokinetic properties, provide reduced immunogenicity, to target a specific cell population, and/or to provide enhanced therapeutic efficacy.

An IL-7Rαγc ligand can be bound to the construct partner through a construct linker.

An IL-7Rαγc ligand construct can comprise a single IL-7Rαγc ligand bound to a construct partner or two or more IL-7Rαγc ligands bound to a construct partner.

Each of the two or more IL-7Rαγc ligands bound to a construct partner can be the same, or at least one of the IL-7Rαγc ligands can be different than at least one of the other IL-7Rαγc ligands bound to the construct partner. The IL-7Rαγc ligands can differ, for example, with respect to the amino acid sequence of the IL-7Rα ligand, the amino acid sequence of the Rγc ligand, the amino acid sequence or the chemical structure of the IL-7Rαγc ligand linker, and/or to the amino acid sequence of flanking amino acids.

Each of the IL-7Rαγc ligands can independently be bound to a construct partner through a respective construct linker. Each of the respective construct linkers can be the same, or at least one of the construct linkers can be different than at least one other construct linker. The construct linkers can differ, for example, with respect to the length and/or to the chemical composition such as the amino acid sequence of the construct linker.

Each of the IL-7Rαγc ligands can independently be bound to a construct partner through the N-terminus or through the C-terminus of the respective IL-7Rαγc ligand.

An IL-7Rαγc ligand construct can comprise a tandem IL-7Rαγc ligand bound to a construct partner. The tandem IL-7Rαγc ligand can be bound to the construct partner through a construct linker.

An IL-7Rαγc ligand construct can comprise a single tandem IL-7Rαγc ligand bound to a construct partner or two or more tandem IL-7Rαγc ligands bound to a construct partner.

Each of the two or more tandem IL-7Rαγc ligands bound to a construct partner can be the same, or at least one of the tandem IL-7Rαγc ligands can be different than at least one of the other tandem IL-7Rαγc ligands bound to the construct partner. The tandem IL-7Rαγc ligands can differ, for example, with respect to the IL-7Rα ligands, the Rγc ligands, the IL-7Rαγc ligand linkers, the tandem linkers, and/or the flanking amino acids.

Each of the tandem IL-7Rαγc ligands can be bound to a construct partner through a respective construct linker. Each of the respective construct linkers can be the same, or at least one of the construct linkers can be different than at least one other construct linker. The construct linkers can differ, for example, with respect to the length and/or to the chemical composition.

Each of the tandem IL-7Rαγc ligands can independently be bound to the construct partner through the N-terminus or the C-terminus of the respective tandem IL-7Rαγc ligand.

An IL-7Rαγc ligand construct can comprise at least one IL-7Rα ligand and at least one tandem Rγc ligand bound to a construct partner. Each of the at least one IL-7Rα ligand and the at least one Rγc ligand can independently be bound to the construct partner through a construct linker. For example, an IL-7Rαγc ligand construct can comprise from 1 to 10 IL-7Rα ligands provided by the present and from 1 to 10 Rγc ligands provided by the present disclosure.

An IL-7Rαγc ligand construct can comprise, for example, at least one IL-7Rαγc ligand, at least one tandem IL-7Rαγc ligand, at least one IL-7Rα ligand, and/or at least one Rγc ligand, providing that the IL-7Rαγc ligand construct comprises at least one IL-7Rα ligand and at least one Rγc ligand.

An IL-7Rαγc ligand construct can compromise one or more IL-7Rαγc ligands bound to a side chain of a molecule such as a side chain of an amino acid forming a polymer or protein.

An IL-7Rαγc ligand construct can compromise one or more IL-7Rαγc ligands in which the one or more IL-7Rαγc ligands is incorporated into the backbone of the polymer or polypeptide. Thus, an IL-7Rαγc ligand construct can comprise one or more IL-7Rαγc ligands in which the one or more IL-7Rαγc ligands are bound to an N-terminus of a polypeptide, bound to a C-terminus of a polypeptide, bound to an amino acid side chain of a polypeptide, and/or incorporated into the amino acid sequence of the polypeptide.

IL-7Rαγc ligand constructs provided by the present disclosure include fusion proteins.

Examples of suitable fusion protein partners include Fc-fragments, immunoglobulins such as IgG1, IgG2, and IgG4, immunoglobulin fragments such as IgG1, IgG2, and IgG4 fragments, naturally occurring proteins such as human serum albumin (HSA), antibodies, other human proteins and mutants and/or variants thereof, proteins, and polypeptides. A fusion protein partner can be a naturally occurring protein, a modified-naturally occurring protein, or a synthetic protein.

A fusion partner can be used to provide a desirable pharmacokinetic profile, for cell-targeting, for dual pharmacology, and/or for enhanced efficacy.

For example, an IL-7Rαγc ligand provided by the present disclosure can be fused to a protein that increases the circulating half-life of the IL-7Rαγc ligand. Fusion of therapeutic proteins with IgG or the IgG-Fc chain can accomplish this by increasing the hydrodynamic radius of the protein, thus reducing renal clearance, and through Neonatal Fc Receptor (FcRn)-mediated recycling of the fusion protein, thus prolonging the circulating half-life. Other fusion proteins can be designed to modify properties such as the pharmacokinetics, biodistribution, pharmacodynamics, pharmacology, cytotoxicity, selectivity, and/or targeting.

An IL-7Rαγc ligand fusion protein provided by the present disclosure can comprise one or more IL-7Rαγc ligands bound to a fusion protein partner. Each of the one or more IL-7Rαγc ligands can be independently bound to a fusion protein partner through the N-terminus or through the C-terminus of the respective IL-7Rαγc ligand. Each of the one or more IL-7Rαγc ligands can be the same. At least one of the one or more IL-7Rαγc ligands can be different than at least one other IL-7Rαγc ligand. The amino acid sequence at the junction between an IL-7Rαγc ligand and a fusion partner protein can be either a direct fusion of the two protein sequences or can be a fusion with an intervening peptidyl fusion linker. Peptidyl linkers can be included as spacers between an IL-7Rαγc ligand and the fusion partner. Peptidyl linkers can promote proper protein folding and stability of the component protein and the one or more IL-7Rαγc ligands, improve protein expression, and/or can enhance bioactivity of the IL-7Rαγc ligand and/or the fusion partner.

Peptidyl construct linkers used in IL-7Rαγc ligand fusion proteins can be designed to be unstructured flexible peptides. Peptidyl linkers can be, for example, rich in glycine and serine, such as repeats of a sequence such as, for example, $(G)_n$ (SEQ ID NO: 9385), (GS). (SEQ ID NO: 9386), $(GGS)_n$ (SEQ ID NO: 9387), $(GGGS)_n$ (SEQ ID NO: 9388), $(GGGGS)_n$ (SEQ ID NO: 9389), or a combination of any of the foregoing, where n is independently an integer from 1 to 10. A flexible peptidyl linker with a fully extended α-strand conformation can have an end-to-end length, for example, of 3.5 Å per residue. Thus, a peptidyl linker of 5, 10, 15, or 10 residues can have a maximum fully extended length, for example, of 17.5 k, 35 k, 52.5 k, 70 k, 140 k, or more than 140 Å, respectively.

Peptidyl construct linkers can be rigid linkers, such as linkers including proline and other amino acids such as alanine, lysine or glutamic acid. For example, a rigid linker can be $(PA)_n$ where n is an integer 1 to 20 (SEQ ID NO: 9421) such as $(PA)_{10}$ (SEQ ID NO: 9428). A peptidyl construct linker can facilitate providing an appropriate conformation and orientation of individual fusion protein moieties to facilitate the engagement of an IL-7Rαγc ligand with the IL-7Rα subunit and/or Rγc subunit of IL-7R, facilitate binding of the IL-7Rαγc ligand to IL-7R, enable fusion protein recycling, and/or prolong the circulating half-life of the IL-7Rαγc ligand.

There are multiple options for the design and construction of a fusion protein comprising one or more IL-7Rαγc ligands and which can be selected to obtain an IL-7Rαγc ligand fusion protein having the desired biological activity and pharmaceutical characteristics. Design options include, for example, the IL-7Rαγc ligand including the selection of the IL-7Rα ligand, the Rγc ligand, and the IL-7Rαγc ligand linker; the fusion partner protein binding moiety; the configuration of the fusion partner binding moiety in the fusion protein; the peptidyl linker binding an IL-7Rαγc ligand to the fusion partner; and the fusion partner protein.

In general, preparation of IL-7Rαγc ligand fusion proteins provided by the present disclosure can be prepared using recognized recombinant DNA techniques involving, for example, polymerase chain amplification reactions (PCR), preparation of plasmid DNA, cleavage of DNA with restriction enzymes, preparation of oligonucleotides, ligation of DNA, isolation of mRNA, introduction of the DNA into a suitable cell, transformation or transfection of a host, and culturing of the host. Additionally, IL-7Rαγc ligand fusion proteins can be isolated and purified using chaotropic agents and using well-known electrophoretic, centrifugation, and chromatographic methods.

IL-7Rαγc ligand fusion proteins provided by the present disclosure can comprise one or more small ubiquitin-related modifier (SUMO) proteins. Modification of cellular proteins by the ubiquitin-like modifier SUMO can regulate various cellular processes, such as nuclear transport, signal transduction, and stabilization of proteins. Once covalently attached to cellular targets, SUMO regulates protein/protein and protein/DNA interactions, as well as localizes and stabilizes the target protein.

For example, an IL-7Rαγc ligand can be bound to a first linker, which is bound to a SUMO protein, which is further bound to a second linker binding the SUMO protein to a fusion partner such as an IgG or Fc-fragment. SUMO fusions can enhance expression, promote solubility, and/or facilitate optimized protein folding. Attachment of a highly stable structure such as that of ubiquitin or SUMO at the N-terminus or at the C-terminus of a fusion partner protein can increase the yield by increasing stability. The solubilizing effect of ubiquitin and ubiquitin-like proteins may also be explained in part by the outer hydrophilicity and inner hydrophobicity of the core structure of ubiquitin and SUMO, exerting a detergent-like effect on otherwise insoluble proteins.

One or more IL-7Rαγc ligands can be bound to a compound that provides desired pharmacokinetic properties. For example, one or more IL-7Rαγc ligands can be bound to a synthetic polymer or to a protein, such as a naturally occurring protein, that exhibits an extended half-life in the systemic circulation.

An IL-7Rαγc ligand provided by the present disclosure can be conjugated to or fused to molecules that extend the serum half-life of the IL-7Rαγc ligand without increasing the risk that such half-life extension would increase the likelihood or the intensity of a side-effect or adverse event in a patient. Dosing of extended serum half-life IL-7Rαγc ligands can allow for prolonged target coverage with lower systemic maximal exposure ($C_{max}$). Extended serum half-life can allow for use of lower administered doses and/or a less frequent dosing regimen of an IL-7Rαγc ligand or IL-7Rαγc ligand construct.

The serum half-life of an IL-7Rαγc ligand can be extended by any suitable method. Such methods include linking an IL-7Rαγc ligand to a peptide that binds to the neonatal Fc receptor or linking an IL-7Rαγc ligand to a protein having extended serum half-life such as IgG, an IgG Fc fragment or to human serum albumin (HSA).

Examples of IL-7Rαγc ligand pharmacokinetic constructs include, (a) recombinantly fusing one or more IL-7Rαγc ligands to a naturally long-half-life protein or protein domain such as Fc fusion, transferrin fusion or albumin fusion; (b) recombinantly fusing one or more IL-7Rαγc ligands to an inert polypeptide such as XTEN®, a homoamino acid polymer (HAP, HAPylation), a proline-alanine-serine polymer (PAS, PASylation), an elastin-like peptide (ELP, ELPylation), or a gelatin-like protein GLK polymer; (c) increasing the hydrodynamic radius by chemical conjugation of one or more IL-7Rαγc ligands to a repeat chemical moiety such as PEGylation or hyaluronic acid; (d) increasing the negative charge of the one or more IL-7Rαγc ligands by polysialylation or by fusing to a negatively charged highly sialylated peptide such as carboxy-terminal peptide (CTP of chorionic gonadotropin (CG) p-chain); or (e) conjugating of one or more IL-7Rαγc ligands to a peptide or protein-binding domain of a normally long half-life protein such as human serum albumin (HSA), transferrin, fusion to the constant fragment Fc chain of a human immunoglobulin IgG, or fusion to non-natural polypeptides such as XTEN®.

One or more IL-7Rαγc ligands can be bound to a synthetic polymer.

For example, an IL-7Rαγc ligands can be conjugated to polyethylene glycol (PEG) chains (to extend the half-life of the IL-7Rαγc ligand in the systemic circulation. A PEG can have a molecular weight, for example, from 5 kDa to 100 kDa, from 10 kDa to 80 kDa, or from 20 kDa to 60 kDa.

PEGylation can be achieved chemically or enzymatically and the biophysical and biochemical properties of the conjugate can depend, for example, on structure, size, number and location of PEG chains. PEGylation can prolong the circulation half-life of an IL-7Rα ligand by masking proteolytic cleavage sites and/or by increasing their hydrodynamic radii, thereby reducing renal clearance.

An IL-7Rαγc ligand can be conjugated to either linear or branched-chain monomethoxy polyethylene glycol (mPEG), resulting in increased in the molecular mass and hydrodynamic radius and decrease the rate of glomerular filtration by the kidney. PEG is a highly flexible uncharged, mostly non-immunogenic, hydrophilic, and non-biodegradable molecule, which generates a larger hydrodynamic radius than an equivalently sized protein. PEGylation has been used to lengthen the half-life of pharmacologically active compounds.

Similar to IgG, serum albumin displays an unusually long circulation half-life. Half-life prolongation of these functionally and structurally unrelated proteins is derived primarily from interaction with FcRn. Although HSA binds FcRn at a different site than IgG, both interactions are pH-dependent and result in FcRn-mediated rescue from cellular catabolism. IL-7Rαγc ligand constructs include, for example, genetic fusion to HSA, conjugation to HSA-binding moieties, and fusion to HSA-binding antibodies or antibody fragments.

One or more IL-7Rαγc ligands can be bound to an XTEN® polypeptide (Amunix Pharmaceuticals Inc.). XTEN® polypeptides are generally 200 amino acids or more in length, are designed to mask antigen binding regions of scFvs, to be unstructured and to have a low immunogenicity. XTEN® polypeptides can increase the circulating half-life of therapeutic agents. One or more IL-7Rαγc ligands can be bound to an XPAT® polypeptide (Amunix Pharmaceuticals, Inc.). XPAT® polypeptides include substrates for proteases and can be designed to be active with one or more proteases, to select the cleavage rate, and to impart specificity.

Genetic fusing of one or more IL-7Rαγc ligands to serum transferrin (Tf) can result in enhanced pharmacokinetics. Serum transferrin is an 80 kDa glycoprotein that mediates iron transport from the systemic circulation into cells and tissues. When bound to ferric ions, transferrin displays high affinity for the transferrin receptors (TfRs) displayed on the surface of most cell types. Upon interaction, the Tf/TfR complex is internalized via receptor-mediated endocytosis into endosomes, where iron is released and Tf/TfR is then recycled to the cell surface. Fusion of protein therapeutics to Tf or TfR-binding antibodies can be used for half-life extension, targeting of malignant cells overexpressing TfRs and targeting of the rai capillary endothelium for transport of therapeutics across the blood brain barrier.

Fusion of an IL-7Rαγc ligand to IgG or Fc can result in increased avidity of the IL-7Rαγc ligand provides for purification via protein G./A affinity chromatography and can prolong the circulation half-life of the IL-7Rαγc ligand.

Half-life extension of IL-7Rαγc ligand/IgG fusion proteins results from a combination of reduced renal clearance due to increased molecular size and FcRn-mediated recycling.

One or more IL-7Rαγc ligands can be bound to any suitable IgG including, for example, IgG1, IgG2, or IgG4. The one or more IL-7Rαγc ligands can be bound to any suitable portion of IgG such as the light chain VL or to the heavy chain VH and including the N-terminus, the C-terminus, an amino acid side chain, or can be incorporated into the amino acid sequence of the light or heavy chain of IgG.

One or more IL-7Rα ligands can be non-covalently bound to albumin. Non-covalent binding of IL-7Rα ligands to albumin can shield the ligands for proteolytic degradation and protect the ligands from rapid renal clearance. The nature of the non-covalent binding allows for the detachment of the IL-7Rα ligand thereby facilitating the ability of the ligand to interact with IL-7R. IL-7Rα ligands can be modified to facilitate non-covalent binding to one or more different albumin binding protein domains that can impart a desired pharmacokinetic property to the IL-7Rα ligand. Alternatively, albumin can be engineered to provide a desired pharmacokinetic profile for an IL-7Rα ligand. These albumin binding domains can be used to improve the pharmacokinetics of larger compounds such as IL-7Rα ligand constructs. An Il-7Rα ligand can be bound to albumin through an albumin binding molecule having, for example, a high affinity to albumin. An albumin binding molecule can be fused to an IL-7Rα ligand either recombinantly or chemically during solid-phase synthesis. Such albumin binding molecules can be either small peptides having less than 20 amino acids or non-peptidic small molecules.

IL-7Rαγc ligand constructs provided by the present disclosure can comprise IL-7Rαγc ligand/IgG constructs.

An IgG construct can comprise at least one heavy chain and at least one light chain. An IL-7Rαγc ligand can be bound to the N-terminus of the heavy chain, to the N-terminus of the light chain, to the C-terminus of the heavy chain, and/or to the C-terminus of the light chain.

An IL-7Rαγc ligand can be bound to the C-terminus of the heavy chain, for example, to the CH3 domain, to the N-terminus of the heavy chain and/or to the N-terminus of the light chain.

In an IgG construct, an IL-7Rαγc ligand can be bound to the N-terminus of one or both heavy chains, to the N-terminus of one or both light chains, and/or to one or both C-termini of the heavy chains.

In an IgG construct, an IL-7Rαγc ligand can be bound to an amino acid side chain of IgG.

In an IgG construct, an IgG heavy chain and/or an IgG light chain can comprise one or more IL-7Rαγc ligands incorporated into the amino acid sequence forming the IgG heavy chain and/or the IgG light chain.

Examples of IL-7Rαγc ligand IgG constructs are shown in FIGS. 14A-14D.

Other examples of IL-7Rαγc ligand constructs are shown in FIGS. 17A-17D. The fusion proteins, linkers, and ligands constituting the IL-7Rαγc ligand constructs in FIGS. 17A-17D are shown in Table 4.

TABLE 4

IL-7Rαγc ligand constructs. Table 4 discloses "(GGGGS)$_2$", "(GS)$_{10}$", and "GGGGS" as SEQ ID NOS 9396, 9407, and 9395, respectively.)

| No. | SEQ ID NO: | Fc Fusion Protein | Construct Linker | IL-7Rα Ligand SEQ ID NO: | Ligand Linker | Rγc Ligand SEQ ID NO: | IL-2Rαγc Ligand SEQ ID NO: |
|---|---|---|---|---|---|---|---|
| FP50 | 1253 | hIgG2-Fc | (GGGGS)$_2$ | 475 | GGGGS | 965 | 1270 |
| FP51 | 1254 | hIgG2-Fc | (GGGGS)$_2$ | 476 | GGGGS | 965 | 1271 |
| FP52 | 1255 | hIgG2-Fc | (GGGGS)$_2$ | 477 | GGGGS | 965 | 1272 |
| FP53 | 1256 | hIgG2-Fc | (GGGGS)$_2$ | 403 | GGGGS | 965 | 1273 |
| FP54 | 1257 | hIgG2-Fc | (GGGGS)$_2$ | 395 | GGGGS | 965 | 1274 |
| FP55 | 1258 | hIgG2-Fc | (GGGGS)$_2$ | 403 | GGGGS | 965 | 1275 |
| FP56 | 1259 | hIgG2-Fc | (GGGGS)$_2$ | 395 | GGGGS | 965 | 1276 |
| FP1 | 1212 | hIgG2-Fc | (GS)$_{10}$ | 407 | GGGGS | 965 | 2012 |
| FP57 | 1260 | hIgG2-Fc | (GS)$_{10}$ | 394 | GGGGS | 965 | 1277 |
| FP58 | 1261 | hIgG2-Fc | (GS)$_{10}$ | 402 | GGGGS | 965 | 1278 |
| FP59 | 1262 | hIgG2-Fc | (GS)$_{10}$ | 402 | GGGGS | 965 | 1279 |
| FP60 | 1263 | hIgG2-Fc | (GS)$_{10}$ | 396 | GGGGS | 965 | 1280 |
| FP61 | 1264 | hIgG2-Fc | (GS)$_{10}$ | 396 | GGGGS | 965 | 1281 |
| FP62 | 1265 | hIgG2-Fc | (GS)$_{10}$ | 397 | GGGGS | 965 | 1282 |
| FP63 | 1266 | hIgG2-Fc | (GS)$_{10}$ | 397 | GGGGS | 965 | 1283 |
| FP8 | 1219 | PEM HC | (GS)$_{10}$ | 407 | GGGGS | 965 | 2012 |

TABLE 4-continued

IL-7Rαγc ligand constructs. Table 4 discloses "(GGGGS)₂", "(GS)₁₀", and "GGGGS" as SEQ ID NOS 9396, 9407, and 9395, respectively.)

| No. | SEQ ID NO: | Fc Fusion Protein | Construct Linker | IL-7Rα Ligand SEQ ID NO: | Ligand Linker | Rγc Ligand SEQ ID NO: | IL-2Rαγc Ligand SEQ ID NO: |
|---|---|---|---|---|---|---|---|
| FP64 | 1267 | hIgG1-Fc-hole | (GS)₁₀ | 407 | GGGGS | 965 | 2012 |
| FP65 | 1268 | hIgG1-Fc-hole | (GS)₁₀ | 407 | GGGGS | 965 | 2012 |
| FP14 | 1225 | hIgG2-Fc | (GS)₁₀ | 407 | GGGGS | 965 | 2012 |
| FP66 | 1269 | hIgG2-Fc | (GS)₁₀ | 458 | GGGGS | 965 | 1284 |
| FP67 | 1270 | hIgG2-Fc | (GS)₁₀ | 409 | GGGGS | 965 | 1285 |
| FP68 | 1271 | hIgG2-Fc | (GS)₁₀ | 457 | GGGGS | 965 | 1286 |
| FP69 | 1272 | hIgG2-Fc | (GS)₁₀ | 457 | GGGGS | 965 | 1287 |
| FP70 | 1273 | hIgG2-Fc | (GS)₁₀ | 471 | GGGGS | 965 | 1288 |
| FP71 | 1274 | hIgG2-Fc | (GS)₁₀ | 467 | GGGGS | 965 | 1289 |
| FP72 | 1275 | hIgG2-Fc | (GS)₁₀ | 465 | GGGGS | 965 | 1290 |

In an IL-7Rαγc ligand construct having an amino acid sequence of any one of SEQ ID NOS: 1270-1290, the IL-7Rα ligand and/or the Rγc ligand can have flanking amino acids such as $(G)_n$ glycines where n is an integer from 1-10 (SEQ ID NO: 9385) such as two glycines (GG) (SEQ ID NO: 9399) on the carboxyl terminus and/or on the amino terminus of the ligand.

In an IL-7Rαγc construct each linker bonding an IL-7Rαγc ligand to the IgG can independently be the same or can be different.

For example, an IL-7Rαγc ligand can be bound to the C-terminus of one or both IgG heavy chains, to the C-terminus of one or both IgG light chains, to the N-terminus of one or both IgG heavy chains, and/or to the N-terminus of one or both IgG light chains. Examples showing IL-7Rαγc ligand constructs in which an IL-7Rαγc ligand is bound to the IgG heavy and/or light chains are shown in FIGS. 14A-14D. Each of the IL-7Rαγc ligands can be bound to the IgG through a suitable construct linker.

One or more IL-7Rαγc ligands can be bound to an IgG fragment such as a single light chain VL domain, a single heavy chain VH domain or to the Fc region. The fragments can be derived from any suitable immunoglobulin such as IgA, IgD, IgE, IgG, or IgM. The fragments can be derived from any suitable IgG such as, for example, IgG1, IgG2, or IgG4.

One or more IL-7Rαγc ligands can be bound to an Fc-fragment. The Fc-fragment can be monomeric, can be dimeric, or can be a modified Fc-fragment. A dimeric Fc-fragment can comprise one or more disulfide bonds on the N-terminus. An example of a modification is a knob-into-hole modification comprising a knob modification in the CH3 domain of one of the immunoglobulin heavy chain and a hole modification in the other immunoglobulin heavy chain.

Constructs provided by the present disclosure include IL-7Rαγc ligand-Fc fusion proteins. An Fc chain can include two different polypeptides that self-assemble into either homodimeric Fc chains or heterodimeric Fc chains. The fusion proteins can include an Fc chain, one or more Fc chain linkers, and one or more IL-7Rαγc ligands. An Fc chain linker binds an IL-7Rαγc ligand provided by the present disclosure to an Fc chain.

The Fc chain can comprise the Fc chain of any suitable immunoglobulin isotype including IgA, IgD, IgE, IgG, and IgM immunoglobulin isotypes. The Fc-fragment can be derived from any suitable IgG immunoglobulin including, for example, an IgG1, IgG2, or IgG4.

An IL-7Rαγc ligand Fc-fusion protein can comprise one or more IL-7Rαγc ligands. Each of the one or more IL-7Rαγc ligands can be the same or can be different than other IL-7Rαγc ligands bound to a Fc chain.

An IL-7Rαγc ligand Fc-fragment construct, i.e., aN IL-7Rαγc ligand Fc fusion, can comprise an IL-7Rαγc ligand bound to the C-terminus of one Fc-chain or to the C-terminus of both Fc-chains of the Fc-fragment.

An IL-7Rαγc ligand Fc fusion can comprise, for example, one IL-7Rαγc ligand bound to the N-terminus of the Fc-fragment or two IL-7Rαγc ligands bound to the N-terminus of the Fc-fragment.

An IL-7Rαγc ligand Fc fusion can comprise one or two IL-7Rαγc ligands bound to the C-terminus of the Fc-fragment and one or two IL-7Rαγc ligands can be bound to the N-terminus of the Fc-fragment.

Each IL-7Rαγc ligand can be covalently bound to an Fc-fragment through an Fc linker. Each Fc linker binding an IL-7Rαγc ligand to an Fc-fragment can be the same or different.

Each IL-7Rαγc ligand can independently be bound to an Fc linker through the N-terminus or through the C-terminus of the IL-7Rαγc ligand.

Examples of IL-7Rαγc ligand Fc-fragment constructs are shown in FIGS. 15A-15F and 16A-16F.

An Fc fusion protein can comprise, for example, two Fc chains with at least one of the Fc chains comprising a fused IL-7Rαγc ligand and optionally an Fc-linker. The dimeric Fc-fusion proteins can be configured to have one IL-7Rαγc ligand, which can be referred to as monovalent IL-7Rαγc ligand-Fc-fusion, where an IL-7Rαγc ligand is covalently bound to one of the Fc chains and the other Fc chain is not bound to an IL-7Rαγc ligand. In a bivalent IL-7Rαγc ligand Fc-fusion an IL-7Rαγc ligand is fused to each Fc chain.

In addition to homodimeric bivalent IL-7Rαγc ligand Fc fusion proteins, in a monovalent IL-7Rαγc ligand Fc-fusion protein, one Fc chain can be empty and heterodimerization variants can be used to bring the two Fc chains together. These embodiments rely on the use of two different variant Fc sequences, that can self-assemble to form heterodimeric Fc chains and heterodimeric Fc fusion proteins. There are a number of mechanisms that can be used to generate the heterodimers. In addition, these mechanisms can be combined to ensure high efficiency of heterodimerization. Heterodimerization variants can include steric variants such as knobs and holes or skew variants, charge pairs variants, and pH variants.

IL-7Rαγc ligand constructs provided by the present disclosure include constructs in which one or more IL-7Rα ligands are bound to a construct partner and independently one or more Rγc ligands are bound to the construct partner. For example, an IL-7Rα ligand can be bound to the C-terminus of an Fc fragment or immunoglobulin and Rγc ligand can be bound to the N-terminus of an Fc fragment or an immunoglobulin. As another example, an IL-7Rα ligand can be bound to the C-terminus of one heavy chain of an Fc fragment or immunoglobulin and an Rγc ligand can be bound to the other heavy chain of the Fc fragment or immunoglobulin.

A construct comprising one or more IL-7Rα ligands and/or one or more Rγc ligands can comprise one or more IL-7Rαγc ligands bound to the construct partner. FIGS. 15A-15F and FIGS. 16A-16F show examples of Fc fragments and immunoglobulins, respectively, in which ligands are bound to the C-terminus and/or to the N-terminus of the construct partner. Each of the ligands can independently be selected from an IL-7Rαγc ligand, an IL-7Rα ligand, or an Rγc ligand.

In constructs comprising a protein or synthetic polymer, one or more IL-7Rα ligands, one or more Rγc ligands, and/or one or more IL-7Rαγc ligands can be bound to the construct partner. For example, the ligands can be bound to the C-terminus and N-terminus of the protein or to the terminal groups of the polymer, and/or to functionalized side chains.

Each of the one or more IL-7Rα ligands and one or more Rγc ligands can independently be bound to a construct partner through a construct linker. The construct linker can be, for example, any of the rigid or flexible linkers disclosed herein, and can be selected to facilitate a desired interaction with IL-7R.

IL-7Rαγc ligand constructs provided by the present disclosure can comprise a construct linker covalently binding an IL-7Rαγc ligand or a tandem IL-7Rαγc ligand to a construct partner including, for example, any of the peptides, polymers, Fc-fragments, immunoglobulin fragments, and antibodies disclosed herein.

A construct linker can be configured to facilitate binding of an IL-7Rαγc ligand to a binding site on IL-7R. A construct linker can be configured to facilitate activation of IL-7R by an IL-7Rαγc ligand.

A construct linker can be a peptidyl construct linker. A peptidyl construct linker can comprise, for example, from 2 to 30 amino acids, from 2 to 25 amino acids, from 2 to 20 amino acids, from 2 to 15 amino acids or from 2 to 10 amino acids. A peptidyl construct linker can comprise, for example, less than 30 amino acids, less than 25 amino acids, less than 20 amino acids, less than 15 amino acids, less than 10 amino acids, or less than 5 amino acids. A peptidyl construct linker can comprise, for example, more than 2 amino acids, more than 4 amino acids, more than 8 amino acids, more than 12 amino acids, or more than 16 amino acids.

A peptidyl construct linker can have a length, for example, from 5 Å to 500 Å, such as from 0 Å to 400 Å, from 50 Å to 300 Å, or from 100 Å to 200 Å. A peptidyl construct linker can have a length, for example, greater than 5 Å, greater than 10 Å, greater than 50 Å, greater than 100 Å, greater than 200 Å, greater than 300 Å, or greater than 400 Å.

A construct linker can be a chemical construct linker. A chemical construct linker can have a length, for example, from 5 to 500 Å, such as from 10 Å to 400 Å, from 5 Å to 300 Å, or from 100 Å to 200 Å. A chemical linker can have a length, for example, greater than 5 Å, greater than 10 Å, greater than 50 Å, greater than 100 Å, greater than 200 Å, greater than 300 Å, or greater than 400 Å.

A chemical construct linker can comprise a backbone comprising, for example, from 3 to 100 bonds, from 5 to 90 bonds, from 10 to 80 bonds, or from 20 to 60 bonds. A chemical construct linker can comprise a backbone comprising, for example, greater than 3 bonds, greater than 5 bonds, greater than 10 bonds greater than 20 bonds greater than 50 bonds, or greater than 100 bonds.

Examples of suitable peptidyl construct linkers include $(GGGGS)_n$ (SEQ ID NO: 9384), $(GGS)_n$ (SEQ ID NO: 9382), $(GGGS)_n$ (SEQ ID NO: 9383), $(GG)_n$ (SEQ ID NO: 9379), $(GS)_n$ (SEQ ID NO: 9381), and $(PA)_n$ (SEQ ID NO: 9421), where n can be an integer from 1 to 20, such as from 2 to 25, from 2 to 20, from 2 to 16, from 3 to 12, from 4 to 10, or from 6 to 8. A peptidyl construct linker can be, for example, $(GS)_{10}$ (SEQ ID NO: 9407) or $(PA)_{10}$ (SEQ ID NO: 9428).

An IL-7Rαγc ligand can be bound to a construct linker through the N-terminus or through the C-terminus of the IL-7Rαγc ligand.

In IL-7Rαγc ligand constructs having more than one IL-7Rαγc ligand, each of the IL-7Rαγc ligands can be bound to the construct partner through an independent construct. Each of the construct linkers can be the same or at least one of the construct linkers can be different. Each of the more than one IL-7Rαγc ligands can be bound to a respective construct partner through the N-terminus or through the C-terminus of the IL-7Rαγc ligand.

A construct linker can comprise a cleavable construct linker. A cleavable construct linker can be cleaved in vivo, for example, in the presence of a certain pH, enzymatically, or by application of energy such as by application of electromagnetic radiation including ultraviolet light or infrared irradiation.

An IL-7Rαγc ligand construct can comprise one or more IL-7Rαγc ligands bound to a checkpoint inhibitor, such as a PD-1 checkpoint inhibitor including, for example, an antibody checkpoint inhibitor such as pembrolizumab and cemiplimab.

In an IL-7Rαγc construct such as a checkpoint inhibitor construct, the one or more IL-7Rαγc ligands can have the amino acid sequence of any one of SEQ ID NOS: 2012-2023, or an amino acid sequence having greater than 60%, greater than 70%, greater than 80%, greater than 85%, greater than 90%, or greater than 95% amino acid sequence similarity to any one of SEQ ID NOS: 2012-2023:

```
                                    SEQ ID NO: 2012
VHRIPWCTLDPGGLQCAWLRQMGGGGSGGVVCQDWEGVELCWQ

SEQ ID NO: 2013
VHRIPWCTLDPGGLQCAWLRQGGGGSGGVVCQDEGVELCWQ

SEQ ID NO: 2014
VHRIPWCTLDPGGLQCAWLRGGGGSGGVVCQDWGVELCWQ

SEQ ID NO: 2015
HRIPWCTLDPGGLQCAWLRQMGGGGSGGVVCQWEGVELCWQ

SEQ ID NO: 2016
HRIPWCTLDPGGLQCAWLRQGGGGSGGVVCQD

SEQ ID NO: 2017
HRIPWCTLDPGGLQCAWLRGGGGSGGVVCQDWGVELCWQ

SEQ ID NO: 2018
RIPWCTLDPGGLQCAWLRQMGGGGSGGVVCQWEGVELCWQ

SEQ ID NO: 2019
RIPWCTLDPGGLQCAWLRQGGGGSGGVVCQDEGVELCWQ

SEQ ID NO: 2020
RIPWCTLDPGGLQCAWLRGGGGSGGVVCQDWWEGVELCWQ

SEQ ID NO: 2021
IPWCTLDPGGLQCAWLRQMGGGGSGGVVCQWEGVELCWQ

SEQ ID NO: 2022
IPWCTLDPGGLQCAWLRQGGGGSGGVVCQDEGVELCWQ

SEQ ID NO: 2023
IPWCTLDPGGLQCAWLRGGGGSGGVVCQDWGVELCWQ
```

In IL-7Rαγc constructs such as checkpoint inhibitor antibody constructs the one or more IL-7Rαγc ligands can have an amino acid sequence of any one of SEQ ID NOS: 2012-2023 or an IL-7Rαγc ligand having an amino acid sequence similarity to any one of SEQ ID NOS: 2012-2023 bound to the C-terminus of one heavy chain, the C-terminus of both heavy chains, the N-terminus of one heavy chain, the N-terminus of both heavy chains, the N-terminus of one light chain, the N-terminus of both light chains, or a combination of any of the foregoing. Each of the one or more IL-7Rαγc ligands can independently be bound to the checkpoint inhibitor antibody through a construct linker, which can comprise, for example, from 1 to 50 amino acids.

The N-terminus of the IL-7Rαγc ligand can be bound to the checkpoint inhibitor antibody through the construct linker.

The construct linker can be selected, for example, from $(G)_n$ (SEQ ID NO: 9385), (GS). (SEQ ID NO: 9386), $(GGS)_n$ (SEQ ID NO: 9387), $(GGGS)_n$ (SEQ ID NO: 9388), $(GGGGS)_n$ (SEQ ID NO: 9389) where n is independently an integer from 1 to 10. The construct linker can be selected, for example, from $(P)_n$ (SEQ ID NO: 9420) or $(PA)_n$ (SEQ ID NO: 9421) where n is an integer from 1 to 20. A construct linker can comprise $(PX)_n$ (SEQ ID NO: 9429) where each X can independently be selected from alanine, lysine, or glutamic acid and n is an integer from 1 to 20. A construct linker can comprise, for example, $(PA)_n$ where n can be, for example, an integer from 1 to 10 (SEQ ID NO: 9423). Each construct linker can be selected such that an IL-7Rαγc ligand to which it is bound is an IL-7R agonist. The linker can be, for example $(GGGGS)_n$ where n is an integer from 1 to 5 (SEQ ID NO: 9324).

An IL-7Rαγc ligand construct can be a pembrolizumab/IL-7Rαγc ligand fusion protein where the light chain has the amino acid sequence of SEQ ID NO: 1218 (FIG. 14B), or an amino acid sequence having greater than 60%, greater than 70%, greater than 80%, greater than 85%, greater than 90%, or greater than 95% amino acid sequence similarity to SEQ ID NO: 1218 (FIG. 14B; FP7); and the heavy chain has the amino acid sequence of SEQ ID NO: 1219 (FIG. 14B; FP8)), or an amino acid sequence having greater than 60%, greater than 70%, greater than 80%, greater than 85%, greater than 90%, or greater than 95% amino acid sequence similarity to SEQ ID NO: 1219 (FIG. 14B; FP8).

A pembrolizumab/IL-7Rαγc ligand fusion protein can comprise two pembrolizumab heavy chains and two pembrolizumab light chains, wherein an IL-7Rαγc ligand having an amino acid sequence of any one of SEQ ID NOS: 2012, 2084-2087, and 2091-2095 or an amino acid sequence having greater than 60%, greater than 70%, greater than 80%, greater than 85%, greater than 90%, or greater than 95% amino acid sequence similarity to SEQ ID NOS: 2012, 2084-2087, and 2091-2095 is bound to the C-terminus of one heavy chain, the C-terminus of both heavy chains, the N-terminus of one heavy chain, the N-terminus of both heavy chains, the N-terminus of one light chain, the N-terminus of both light chains, or a combination of any of the foregoing. Each of the one or more IL-7Rαγc ligands can independently be bound to the pembrolizumab antibody through a construct linker, which can comprise, for example, from 1 to 50 amino acids.

The N-terminus of the IL-7Rαγc ligand can be bound to pembrolizumab through the construct linker.

The construct linker can be selected, for example, from $(G)_n$ (SEQ ID NO: 9385), (GS). (SEQ ID NO: 9386), $(GGS)_n$ (SEQ ID NO: 9387), $(GGGS)_n$ (SEQ ID NO: 9388), $(GGGGS)_n$ (SEQ ID NO: 9389), or a combination of any of the foregoing, where n can independently be an integer from 1 to 10. The construct linker can be selected, for example, from $(P)_n$ (SEQ ID NO: 9420) or $(PA)_n$ (SEQ ID NO: 9421) where n is an integer from 1 to 20. A construct linker can comprise $(PX)_n$ (SEQ ID NO: 9429) where each X can independently be selected from alanine, lysine, and glutamic acid and n can be an integer from 1 to 20. A construct linker can comprise, for example, (PA)~ where n can be, for example, an integer from 1 to 10 (SEQ ID NO: 9423). Each construct linker can be selected such that an IL-7Rαγc ligand to which it is bound is an IL-7R agonist. The linker can be, for example $(GGGGS)_n$ where n is an integer from 1 to 5 (SEQ ID NO: 9394).

An IL-7Rαγc ligand construct can be a hIgG2/IL-7Rαγc ligand fusion protein where hIgG2 has the amino acid sequence of SEQ ID NO: 1211 (FIG. 11) or an amino acid sequence greater than 60%, greater than 70%, greater than 80%, greater than 85%, greater than 90%, or greater than 95% amino acid sequence similarity to SEQ ID NO: 1211 (FIG. 11) and one or more IL-7Rαγc ligands having an amino acid sequence of SEQ ID NOS: 2012, 2084-2087, and 2091-2095 or an amino acid sequence greater than 60%, greater than 70%, greater than 80%, greater than 85%, greater than 90%, or greater than 95% amino acid sequence similarity to SEQ ID NOS: 2012, 2084-2087, and 2091-2095 is bound to one C-terminus of hIgG2, both C-termini of hIgG2, one N-terminus of hIgG2, both N-termini of hIgG2, or a combination of any of the foregoing. Each of the one or more IL-7Rαγc ligands can independently be bound to IgG2 through a construct linker, which can comprise, for example, from 1 to 50 amino acids. The IgG fusion partner can be hIgG1 or hIgG4 and the one or more IL-7Rαγc ligands can be bound to the hIgG1 or hIgG4 fusion partner as described for hIgG2.

The N-terminus of the IL-7Rαγc ligand can be bound to hIgG2 through the construct linker.

The construct linker can be selected, for example, from (G)$_n$ (SEQ ID NO: 9385), (GS). (SEQ ID NO: 9386), (GGS)$_n$ (SEQ ID NO: 9387), (GGGS)$_n$ (SEQ ID NO: 9388), (GGGGS)$_n$ (SEQ ID NO: 9389) or a combination of any of the foregoing, where n can be an integer from 1 to 10, such as from 1 to 6 or from 1 to 3. The construct linker can be selected, for example, from (P)$_n$ (SEQ ID NO: 9420) or (PA)$_n$ (SEQ ID NO: 9421) where n is an integer from 1 to 20. A construct linker can comprise (PX)$_n$ (SEQ ID NO: 9429) where each X can independently be selected from alanine, lysine, and glutamic acid and n can be an integer from 1 to 20. A construct linker can comprise, for example, (PA)~ where n can be, for example, an integer from 1 to 10 (SEQ ID NO: 9423). Each construct linker can be selected such that an IL-7Rαγc ligand to which it is bound is an IL-7R agonist. The linker can be, for example (GGGGS)$_n$ where n is an integer from 1 to 5 (SEQ ID NO: 9394).

An IL-7Rαγc ligand/immunoglobulin fusion protein can comprise one or more IL-7Rαγc ligands bound to an immunoglobulin such as hIgG1, hIgG2, hIgG3, or hIgG4. Examples of IL-7Rαγc ligand/immunoglobulin constructs are shown in FIGS. 15A-15F and 16A-16F, where the immunoglobulin comprises heavy chains 231 and light chains 232, and IL-7Rαγc ligands 233 bound to either the C-terminus and/or N-terminus of the heavy chains 231 and/or light chains 232.

An IL-7Rαγc ligand construct can comprise one or more IL-7Rαγc ligands bound to an immunoglobulin Fc-fragment. The one or more IL-7Rαγc ligands can have the amino acid sequence of SEQ ID NOS: 2012, 2084-2087, and 2091-2095, or an amino acid sequence having greater than 60%, greater than 70%, greater than 80%, greater than 85%, greater than 90%, or greater than 95% amino acid sequence similarity to SEQ ID NOS: 2012, 2084-2087, and 2091-2095. The IL-7Rαγc ligands can be bound to the C-terminus and/or to the N-terminus and to one or both of the Fc-chains of the Fc fragment. As shown in FIGS. 15A-15F and 16A-16F, an IL-7Rαγc ligand 223 can be bound to one or both Fc-chains 221 and 222.

The Fc-fragment can be derived, for example, from any suitable immunoglobulin such as hIgG1, hIgG2, hIgG3, or hIgG4.

The N-terminus of the IL-7Rαγc ligand can be bound to an Fc-fragment through the construct linker. The construct linker can be selected, for example, from (G)$_n$ (SEQ ID NO: 9385), (GS). (SEQ ID NO: 9386), (GGS)$_n$ (SEQ ID NO: 9387), (GGGS)$_n$ (SEQ ID NO: 9388), (GGGGS)$_n$ (SEQ ID NO: 9389) or a combination of any of the foregoing, where n can independently be an integer from 1 to 10, such as from 1 to 6 or from 1 to 3. The construct linker can be selected, for example, from (P)$_n$ (SEQ ID NO: 9420) or (PA)$_n$ (SEQ ID NO: 9421) where n is an integer from 1 to 20. A construct linker can comprise (PX)$_n$ (SEQ ID NO: 9429) where each X can independently be selected from alanine, lysine, and glutamic acid and n can be an integer from 1 to 20. A construct linker can comprise, for example, (PA)$_n$ where n can be, for example, an integer from 1 to 10 (SEQ ID NO: 9423). Each construct linker can be selected such that an IL-7Rαγc ligand to which it is bound is an IL-7R agonist. The linker can be, for example (GGGGS)$_n$ where n is an integer from 1 to 5 (SEQ ID NO: 9394).

Functionally, IL-7Rαγc binding compounds can be IL-7R agonists, IL-7R antagonists, diagnostic reagents, imaging reagents, targeting compounds, cytotoxic compounds, and compounds exhibiting dual pharmacology.

IL-7Rαγc binding compounds provided by the present disclosure can be attached to one or more moieties that impart a property to the compound that enhances therapeutic efficacy. Examples of properties include potency, aqueous solubility, polarity, lipophilicity, pharmacokinetics, targeting, bioavailability, pH-dependent binding, bioactivity, pharmacodynamics, cellular activity, metabolism, efficacy, reversible incapacitation (caging), selectivity, or a combination of any of the foregoing.

IL-7Rαγc binding compounds can comprise one or more moieties that are cleavable in vivo. The moiety can be cleavable in a target specific environment such as, for example, by a target specific or target enriched enzyme, or pH. The moiety can be cleavable upon exposure to electromagnetic energy such as visible light or infrared radiation and/or by exposure to thermal energy.

IL-7Rαγc binding compounds can include a tumor-targeting moiety such as, for example, a tumor-specific antibody, a tumor-specific antibody fragment, a tumor-specific protein, a tumor-specific peptide, a non-peptidyl tumor cell ligand, or a combination of any of the foregoing.

IL-7Rαγc binding compounds can include an immune cell-targeting moiety such as, for example, an immune cell-specific antibody, an immune cell-specific antibody fragment, an immune cell-specific protein, an immune cell-specific peptide, a non-peptidyl immune cell-ligand, or a combination of any of the foregoing.

IL-7Rαγc binding compounds provided by the present disclosure can include compounds that act as IL-7R agonists.

An IL-7Rαγc binding compound can bind to IL-7Rα subunit and Rγc subunit and can activate the IL-7 receptor. An IL-7R agonist can independently bind to the IL-7Rα subunit and to Rγc subunit with an IC$_{50}$, for example, of less than 100 μM, less than 10 μM, less than 1 μM, less than 100 nM, less than 10 nM, or less than 1 nM. An IL-7R agonist can bind to the IL-7Rα subunit and/or to the Rγc either competitively or non-competitively with IL-7.

An IL-7Rαγc binding compound comprising an IL-7Rα ligand and an Rγc ligand can be configured to more potently activate cells expressing the IL-7Rα subunit and the Rγc subunit, thereby facilitating the ability to differentially activate IL-7R expressed on the surface of different cell types by controlling dose of the agonist. For example, when incubated with a heteromeric compound comprising an IL-7Rα ligand and Rγc ligand, primary human peripheral blood mononuclear cells (PBMC) expressing the IL-7R subunits phosphorylate signal transducer and activator of transcription 5 (STAT5).

An IL-7Rαγc binding compound can partially activate the IL-7 receptor. Partial activation refers to a level of activation, that is, for example, less than 75% of maximum activation, less than 50%, less than 25%, less than 10%, or less than 1% of the maximum activation. Maximum activation (E$_{max}$) is the amplitude of cellular signal (activation) achievable at high agonist concentration such as a high concentration of IL-7. Partial IL-7R agonists can be effective in modulating the levels of response of IL-7R to activation of the IL-7Rα and Rγc subunits among different cell types expressing IL-7R. For example, different cell types are known to vary in expression levels of each of the IL-7R subunits, i.e, the IL-7Rα and Rγc subunits, and to exhibit different sensitivities to IL-7R agonists.

An IL-7Rαγc binding compound can comprise an IL-7Rα ligand and a modified Rγc ligand. Modified Rγc ligands can be selected or designed to bind and activate IL-7R, but with low or modest affinity and potency to IL-7R. Such IL-7R agonists can have greater differential sensitivity for IL-7R activation between cells that highly express IL-7Rα and cells having a low level of IL-7Rα expression.

IL-7Rαγc binding compound can comprise one or more IL-7Rα ligands and one or more Rγc ligands. The presence of multiple IL-7Rα ligands and multiple Rγc ligands can preferentially increase the potency of the IL-7R agonists on cells that highly express IL-7Rα and/or Rγc compared to cells having low expression levels of IL-7Rα and/or Rγc.

An IL-7Rαγc binding compound can comprise a moiety having an additional pharmacological activity other than that mediated by activation of the IL-7 receptor. The pharmacological activity can be an activity that has a therapeutic efficacy that is synergistic with that of the IL-7R agonist or the pharmacological activity can be an activity that has a therapeutic efficacy that is not synergistic with that of the IL-7R agonist. Examples of suitable pharmacological moieties include antibodies and antibody fragments that are inhibitors of checkpoint molecules, pro-apoptotic and anti-apoptotic molecules, cytotoxic molecules, agonists of chemokine, antagonists of chemokine, cytokine, growth factor and other cell surface receptors, and ligands and inhibitors of cell surface adhesion molecules such as integrins.

One or more IL-7Rαγc ligands can be bound to a molecule comprising a targeting moiety that confers the ability to target the one or more IL-7Rαγc ligands to specific tissues or cells in a patient. A targeting moiety can have an affinity for a cell-surface protein or receptor expressed on the surface of a target tissue or target cell, and thereby can direct an IL-7Rαγc ligand to the target tissue or cell. Examples of targeting moieties include antigen binding moieties including antibodies and fragments thereof specific for cell surface proteins, ligands, biological receptors, and antigens.

An antibody can bind to an antigen expressed on the surface of the target cell type. The antibody may not have any useful or known useful pharmacologic function but serves to direct an IL-7Rαγc ligand construct to preferentially target a cell type or tissue compared to cell types or tissues not expressing the targeted antigen or having an expression level of the targeted antigen less than that of the targeted cell type or tissue. An antibody can have a useful pharmacological function when bound to a cell surface antigen. These constructs are referred to as dual pharmacology IL-7Rαγc ligand constructs.

An IL-7Rαγc ligand fusion protein can comprise one or more antigen binding moieties. The two more antigen binding moieties can be directed to the same antigen or to different antigens.

A targeting moiety can be an antigen binding moiety and the IL-7Rαγc ligand fusion protein can be an immunoconjugate. The immunoconjugate can comprise one or more antigen binding moieties capable of binding to an antigen expressed on a cell surface, on the surface of virus-infected cells on the surfaces of diseased cells in the blood serum, and/or in the extracellular matrix.

An antigen binding moiety can comprise an antibody or an antibody fragment. The antigen binding moiety can be an immunoglobulin molecule such as, for example, an IgG class immunoglobulin, including an IgG1, IgG2, or IgG4 isotype. An IL-7Rαγc ligand can be bound to one or both of the heavy chains such as at the C-terminus of the CH3 domain. An antigen binding moiety can be a Fab molecule, an scFv molecule, or a peptide.

An antigen binding moiety can be directed to any specific antigen such as, for example, an antigen expressed on the surface of a tumor cell or in a tumor cell environment, an antigen expressed on an immune cell, an antigen expressed on the surface of a cell expressing predominantly the IL-7Rα and Rγc subunits of IL-7R such as CD4+ T-cells, CD8+ T-cells, or NK cells.

Examples of suitable antigen targets expressed on tumor cells include fibroblast activation protein (FAP), the A1 domain of tenascin-C (TNC A1), the A2 domain of tenascin-C (TNC A2), the extradomain B of fibronectin (EDB), carcinoembryonic antigen (CEA), and the melanoma-associated chondroitin sulfate proteoglycan (MCSP).

Other examples of suitable tumor antigens that can be used for targeting include MAGE, MART-1/Melan-A, gp100, Dipeptidyl peptidase IV (DPPIV), adenosine deaminase-binding protein (ADAbp), cyclophilin b, Colorectal associated antigen (CRC)-0017-A/GA733, Carcinoembryonic Antigen (CEA) and its immunogenic epitopes CAP-1 and CAP-2, etv6, aml1, Prostate Specific Antigen (PSA) and its immunogenic epitopes PSA-1, PSA-2, and PSA-3, prostate-specific membrane antigen (PSMA), T-cell receptor/CD3-zeta chain, MAGE-family of tumor antigens (e.g., MAGE-A1, MAGE-A2, MAGE-A3, MAGE-A4, MAGE-AS, MAGE-A6, MAGE-A7, MAGE-AS, MAGE-A9, MAGE-A10, MAGE-A11, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-CS), GAGE-family of tumor antigens such as GAGE-I, GAGE-2, GAGE-3, GAGE-4, GAGE-5, GAGE-6, GAGE-7, GAGE-8, GAGE-9, BAGE, RAGE, LAGE-I, NAG, GnT-V, MUM-1, CDK4, tyrosinase, p53, MUC family, HER2/neu, p21ras, RCAS1, α-fetoprotein, E-cadherin, a-catenin, -catenin and γ-catenin, p120ctn, gp100 Pmel117, PRAME, NY-ESO-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, Imp-1, PIA, EBY-encoded nuclear antigen (EBNA)-1, brain glycogen phosphorylase, SSX-1, SSX-2 (HOM-MEL-40), SSX-1, SSX-4, SSX-5, SCP-1 and CT-7, and cerbB-2.

Examples of viral antigens include influenza virus hemagglutinin, Epstein-Barr virus LMP-1, hepatitis C virus E2 glycoprotein, HIV gp160, and HIV gp120.

Examples of ECM antigens include syndecan, heparanase, integrins, osteopontin, link, cadherins, laminin, laminin type EGF, lectin, fibronectin, notch, tenascin, and matrixin.

Targeted IL-7Rαγc ligand fusion proteins can be configured to bind, for example, to a cell surface antigen selected from FAP, Her2, EGFR, IGF-1R, CD2 (T-cell surface antigen), CD3 (heteromultimer associated with the TCR), CD22 (B-cell receptor), CD23 (low affinity IgE receptor), CD30 (cytokine receptor), CD33 (myeloid cell surface antigen), CD40 (tumor necrosis factor receptor), IL-6R (IL6 receptor), CD20, MCSP, and PDGFR (platelet-derived growth factor receptor).

A targeted IL-7Rαγc ligand construct can comprise an antigen binding moiety capable of binding to an antigen or to a receptor expressed on the surface of a cell by a cell that also expresses IL-7R. Examples of cells expressing IL-7R include, for example, naïve T-cells, memory T-cells and activated T-cells such as CD8+ T-cells, CD4+ T-cells.

A targeted IL-7Rαγc ligand construct can comprise an antigen binding moiety capable of binding to an antigen or a receptor expressed by a cell that expresses the IL-7Rα and Rγc subunits of IL-7R. Examples of cells expressing the IL-7Rα and Rγc subunits of IL-7R include, for example, naïve T-cells, memory T-cells, and activated T-cells such as CD4+ T-cells, and CD8+ T-cells.

Examples of antigens expressed on the surface of naïve CD4+ T-cells include CD4+, CD45RA+, CD45RO−, CCR7+, and CD25.

Examples of antigens expressed on the surface of naïve CD8+ T-cells include CD8+, CD45RA+, CD45O+, CCR7+, and CD28+.

Examples of antigens expressed on the surface of CD4+ T-cells include Th1 cell markers such as CD4+, CXCR3+, CCR5+, and IL12RD2+; Th2 cell markers such as CD4+, CCR4+, and IL12RD2+; Th9 cell markers such as CD4+, CCR3+, and CCR5+; Th17 cell markers such as CD4+, CCR6+, CCR4+, and NK1.1+; Th22 cell markers such as CD4+, CCR10+, CCR4+, and CCR6+; Treg cell markers such as CD4+, CD127+, CD24+, and CTLA-4+; and Tfh cell markers such as CD4+, CXCR5+, CD40L+, and ICOS+.

Examples of antigens expressed on the surface of cytotoxic CD8+ T cell include CD8+ and CCR7-.

Examples of memory T-cell antigens include CCR5, CCR7, CD11a, CD27, CD28, CD45RA, CD45RO, CD57, and/CD62.

Examples of naïve T-cell antigens include CD45RA, CCR7, CD62L, CD127, and CD132.

A targeted IL-7Rαγc ligand construct can comprise an antigen binding moiety capable of binding to an antigen or receptor expressed on the surface of cells having a role in regulating the immune response.

Examples of antigens expressed by cells associated with regulating the immune response include PD-1, CTLA-4, CD20, and CD30.

A targeted IL-7Rαγc ligand construct can comprise an antigen binding moiety capable of binding to an antigen or receptor expressed on the surface of Treg cells such as CD25. For example, a Treg cell-targeted construct can comprise an IL-7Rαγc ligand/daclizumab antibody fusion.

A dual pharmacology IL-7Rαγc ligand construct provided by the present disclosure can comprise an IL-7Rαγc ligand provided by the present disclosure and a pharmacological moiety. A pharmacological moiety can exert a therapeutic effect on cells expressing IL-7R or on cells other than those expressing IL-7R. One or more IL-7Rαγc ligands can be linked to a biological agent including therapeutic compounds such as, for example, antineoplastic agents, antimicrobial agents, hormones, immunomodulators, and anti-inflammatory agents.

A dual pharmacology IL-7Rαγc ligand construct can comprise, for example, a protein such as an antibody. An antibody can be an IgA isotype, IgD isotype, IgE isotype, IgG isotype, or IgM isotype. A dual pharmacology IL-7Rαγc ligand construct can comprise an IL-7Rαγc ligand coupled to a pharmacologically active antibody through a linker. The linker can be a naturally occurring molecule or a synthetic molecule.

A dual pharmacology IL-7Rαγc ligand construct can comprise an antibody having an antigen binding moiety and one or more IL-7Rαγc ligands bound to the Fc chain through an Fc linker.

An antibody can comprise an antibody directed to a cell-specific antigen. Examples of antibodies directed to cell-specific antigens include alemtuzumab (CD52 antigen), trastuzumab (Her2 protein), ibritumomab tiuxetan (CD20 antigen), brentuximab vedotin (CD30 antigen), ado-trastuzumab emtansine (Her2 protein), blinatumomab (CD19 protein and CD3 protein).

A dual pharmacology IL-7Rαγc ligand construct can comprise a moiety known to be useful in treating cancer. Examples of monoclonal antibodies known to be useful in treating cancer include alemtuzmab, atezolizumab, avelumab, bevacizumab, brentuximab, cemiplimab cetuximab, trastuzumab, denosumab, rituximab, ipilimumab, nivolumab, obinutuzumab, ofatumumab, panitumumab, pembrolizumab, pertuzumab, rituximab, and trastuzumab.

A dual pharmacology IL-7Rαγc ligand construct can comprise a moiety known to be a checkpoint inhibitor such as CTLA-4 inhibitors, PD-1 inhibitors, PD-L1, and PD-L2 inhibitors.

Examples of suitable PD-1 inhibitors include nivolumab, cemiplimab, and pembrolizumab; examples of CTLA-4 inhibitors include ipilimumab; and examples of PD-L1 inhibitors include atezolizumab and durvalumab.

Examples of monoclonal antibodies useful in treating autoimmune and inflammatory diseases include abciximab, adalimumab, alefacept, alemtuzumab, basiliximab, belimumab, bezlotuxumab, canakinumab, certolizumab, daclizumab, denosumab, efalizumab, golimumab, inflectra, ipilimumab, ixekizumab, natlizumab, nivolumab, olaratumab, amalizumab, palivizumab, panitumumab, pembrolizumab, rituximab, tocilizumab, trastuzumab, secukinumab, and ustekinumab.

A dual pharmacology IL-7Rαγc ligand antibody construct can comprise an antibody to a checkpoint inhibitor. Antibodies to checkpoint inhibitors include CTLA-4 blockade blocking antibodies, PD-1 inhibitors such as nivolumab, pembrolizumab, and spartalzumab; PD-L1 inhibitors such as atezolizumab; and other antibodies targeting intrinsic checkpoint blockades such as CISH.

Suitable FDA-approved antibody checkpoint inhibitors include ipilimumab (CTLA-4), nivolumab (PD-1), pembrolizumab (PD-1), atezolizumab (PD-1), avelumab (PD-1), durvalumab (PD-1), and cemiplimab (PD-1).

A dual pharmacology IL-7Rαγc ligand construct can comprise a cytokine fusion. An IL-7Rαγc ligand cytokine construct can comprise one or more IL-7Rαγc ligands and one or more cytokines bound to a naturally occurring or synthetic molecule. For examples, one or more IL-7Rαγc ligands and one or more cytokines can be bound to a polypeptide or to a protein such as an IgG or an Fc-fragment. A cytokine can be selected from, for example, an interleukin, a chemokine, a colony-stimulating factor, an interferon, a transforming growth factor, and a tumor necrosis factor.

An IL-7Rαγc ligand construct provided by the present disclosure can comprise a virology construct. A virology construct can comprise an IL-7Rαγc ligand provided by the present disclosure to protein expressed on the surface of a virus, an antigen expressed on the surface of a cell targeted by the virus, a cell surface antigen targeted by the virus, or a virus-like particle, or a vaccine.

Certain IL-7Rαγc ligands and IL-7Rαγc ligand constructs provided by the present disclosure can be synthesized using recombinant DNA technology.

Certain IL-7Rαγc ligands and IL-7Rαγc ligand constructs provided by the present disclosure can be synthesized using synthetic organic chemistry methods.

IL-7Rαγc ligands and IL-7Rαγc ligand constructs provided by the present disclosure are agonists of IL-7R.

An IL-7Rαγc ligand and IL-7Rαγc ligand construct can bind to the IL-7Rα subunit and/or to the Rγc subunit of IL-7R and can activate IL-7R. An IL-7Rαγc ligand or IL-7Rαγc ligand construct can independently bind to the IL-7Rα subunit and/or to the Rγc subunit with an $IC_{50}$, for example, of less than 100 μM, less than 10 μM, less than 1 μM, less than 100 nM, less than 10 nM, or less than 1 nM.

An IL-7Rαγc ligand or IL-7Rαγc ligand construct can bind to the IL-7Rα subunit and/or to the Rγc subunit with an $IC_{50}$, for example, of less than 100 μM, less than 10 μM, less than 1 µM, less than 100 nM, less than 10 nM, or less than 1 nM. An IL-7Rαγc ligand or IL-7Rαγc ligand construct can bind to the IL-7Rα subunit and/or to the Rγc subunit either competitively or non-competitively with IL-7.

An IL-7Rαγc ligand or IL-7Rαγc ligand construct can be configured to more potently activate cells expressing the IL-7Rα subunit and the Rγc subunit, thereby facilitating the ability to differentially activate IL-7R expressed on the surface of different cell types by controlling a dose of an IL-7Rαγc ligand agonist or IL-7Rαγc ligand construct agonist. For example, when incubated with an IL-7Rαγc ligand or an IL-7Rαγc ligand construct, primary human peripheral blood mononuclear cells (PBMC) expressing the IL-7Rαγc subunit phosphorylate signal transducer and activator of transcription 5 (STAT5).

The $EC_{50}$ for STAT5 phosphorylation in TF-1-7α or hPMBCs induced by an IL-7Rαγc ligand or an IL-7Rαγc ligand construct can be, for example, less than 100 µM, less than 10 µM, less than 1 µM, less than 100 nM, less than 10 nM, or less than 1 nM.

The $EC_{50}$ for STAT5 phosphorylation in TF-1-7α cells induced by an IL-7Rαγc ligand or an IL-7Rαγc ligand construct can be, for example, within a range from 1 pM to 100 µm, from 10 µM to 10 µm, or from 100 pM to 1 µm.

IL-7Rαγc ligands and IL-7Rαγc ligand constructs provided by the present disclosure can activate the STAT5 phosphorylation pathway, the AKT phosphorylation pathway, and the ERK1/2 phosphorylation pathway in CD4+ and CD8+ cells.

An IL-7Rαγc ligand or IL-7Rαγc ligand construct can partially activate IL-7R. Partial activation refers to a level of activation, that is, for example, less than 75% of maximum activation, less than 50%, less than 25%, less than 10%, or less than 1% of the maximum activation. Maximum activation ($E_{max}$) of IL-7R refers to the amplitude of cellular signal (activation) achievable at high agonist concentration such as a high concentration of IL-7. Partial IL-7R agonists can be effective in modulating the levels of response of IL-7R to activation of the IL-7Rα and Rγc subunits among different cell types expressing IL-7R. For example, different cell types are known to vary in expression levels of each of the IL-7R subunits, IL-7Rα and Rγc, and to exhibit different sensitivities to IL-7R agonists.

An IL-7Rαγc ligand or IL-7Rαγc ligand construct can comprise modified IL-7Rα ligands and/or Rγc ligands. Modified IL-7Rα and Rγc ligands can be selected or designed to bind and activate IL-7R, but with low or modest affinity and potency to IL-7R. Such IL-7Rαγc ligands and IL-7Rαγc ligand constructs can have greater differential sensitivity for IL-7R activation between cells that highly express IL-7Rα and cells having a low level of IL-7Rα expression.

IL-7Rαγc ligands and IL-7Rαγc ligand constructs provided by the present disclosure can act as full IL-7R agonists, partial IL-7R agonists, biased IL-7R agonists, or IL-7R antagonists.

As shown in the examples, an IL-7Rαγc binding compound can act as a full agonist comparable to IL-7 with respect to STAT5 phosphorylation in TF-1 IL-7Rα (TF-1-7α) cells and in resting human PMBCs.

As shown in the examples, with respect to STAT5 phosphorylation in TF-1 IL-7Rα cells and in resting human PMBCs, an IL-7Rαγc binding compound provided by the present disclosure can exhibit agonist activity at less than 1 nm ($EC_{50}$).

IL-7Rαγc ligands and IL-7Rαγc ligand constructs provided by the present disclosure can act as IL-7R antagonist.

An IL-7Rαγc ligand antagonist and IL-7Rαγc ligand construct antagonist provided by the present disclosure can bind to IL-7R with an $IC_{50}$, for example, of less than 100 µM, less than 10 µM, less than 1 µM, less than 0.1 µM, or less than 0.01 µM and exhibits no detectable functional activity as determined, for example, using any of the functional assays disclosed in the examples such as the STAT5 phosphorylation assay.

IL-7Rαγc binding compounds, i.e., IL-7Rαγc ligands, tandem IL-7Rαγc ligands, and IL-7Rαγc ligand constructs provided by the present disclosure, can be incorporated into pharmaceutical compositions to be administered to a patient by any appropriate route of administration including intradermal, intramuscular, intraperitoneal, intravenous, subcutaneous, intranasal, epidural, oral, peroral, sublingual, intracerebral, intravaginal, transdermal, rectal, inhalation, or topical. A pharmaceutical composition provided by the present disclosure can be an injectable formulation. Pharmaceutical compositions provided by the present disclosure can be injectable intravenous formulations. Pharmaceutical compositions provided by the present disclosure can be oral formulations. Oral formulations may be oral dosage forms. A pharmaceutical composition may be formulated for intravenous administration or for subcutaneous administration.

Pharmaceutical compositions provided by the present disclosure may comprise a therapeutically effective amount of an IL-7Rαγc binding compound together with a suitable amount of one or more pharmaceutically acceptable vehicles so as to provide a composition for proper administration to a patient. Suitable pharmaceutical vehicles and methods of preparing pharmaceutical compositions are described in the art.

Accordingly, it is within the capability of those of skill in the art to assay and use IL-7Rαγc binding compounds and/or pharmaceutical compositions thereof for therapy.

IL-7Rαγc binding compounds, and/or pharmaceutical composition thereof can generally be used in an amount effective to achieve the intended purpose. For use to treat a disease such as cancer, an autoimmune disease or an inflammatory disease, an IL-7Rαγc binding compound, and/or pharmaceutical composition thereof, may be administered or applied in a therapeutically effective amount.

The amount of an IL-7Rαγc binding compound, and/or pharmaceutical composition of any of the foregoing that will be effective in the treatment of a particular disorder or condition disclosed herein will depend in part on the nature of the disorder or condition, and can be determined by standard clinical techniques known in the art. In addition, in vitro or in vivo assays may optionally be employed to help identify optimal dosage ranges. The amount of an IL-7Rαγc binding compound, and/or pharmaceutical composition of any of the foregoing administered will depend on, among other factors, the patient being treated, the weight of the patient, the severity of the affliction, the manner of administration and the judgment of the prescribing physician.

An IL-7Rαγc binding compound can be assayed in vitro and in vivo, for the desired therapeutic activity, prior to use in humans. For example, in vitro assays may be used to determine whether administration of a specific compound or a combination of compounds is preferred. The compounds can also be demonstrated to be effective and safe using animal model systems.

In certain embodiments, a therapeutically effective dose of an IL-7Rαγc binding compound, and/or pharmaceutical composition of any of the foregoing will provide therapeutic benefit without causing substantial toxicity. Toxicity of an IL-7Rαγc binding compound, and/or pharmaceutical compositions of any of the foregoing may be determined using standard pharmaceutical procedures and may be readily ascertained by the skilled artisan. The dose ratio between toxic and therapeutic effect is the therapeutic index. An IL-7Rαγc binding compound, and/or pharmaceutical composition of any of the foregoing exhibits a particularly high therapeutic index in treating disease and disorders. A dose of an IL-7Rαγc binding compound, and/or pharmaceutical composition of any of the foregoing will be within a range of circulating concentrations that include an effective dose with minimal toxicity.

An IL-7Rαγc binding compounds provided by the present disclosure or a pharmaceutical composition thereof may be included in a kit that may be used to administer the compound to a patient for therapeutic purposes. A kit may include a pharmaceutical composition comprising an IL-7Rαγc binding compounds provided by the present disclosure suitable for administration to a patient and instructions for administering the pharmaceutical composition to the patient. The kit can be a kit for treating cancer, for treating an autoimmune disease, or for treating an inflammatory disease. A kit for use in treating cancer in a patient can comprise an IL-7Rαγc binding compound provided by the present disclosure, a pharmaceutically acceptable vehicle for administering the compound, and instructions for administering the compound to a patient.

The pharmaceutical compositions can be included in a container, pack, or dispenser together with instructions for administration.

Instructions supplied with a kit may be printed and/or supplied, for example, as an electronic-readable medium, a video cassette, an audiotape, a flash memory device, or may be published on an internet web site or distributed to a patient and/or health care provider as an electronic communication.

IL-7Rαγc binding compounds provided by the present disclosure can be useful when combined with certain vaccines, including cancer neo-antigen vaccines. Mutations in tumor DNA produces new protein sequences that are foreign to the body. Vaccines can be designed to specifically activate a patient's immune system with respect to tumor-specific neo-antigens. When administered in combination with a neo-antigen vaccine, IL-7Rαγc binding compounds provided by the present disclosure can expand and proliferate neo-antigen-specific T-cells in the tumor microenvironment and thereby drive maximal expansion of vaccine-induced neo-antigen-specific T-cells for the treatment of cancer.

Thus, IL-7Rαγc ligands and IL-7Rαγc constructs provided by the present disclosure can be used as adjuvants. An adjuvant refers to a compound that enhances the efficacy of a vaccine without directly participating in the protective immunity. For example, an IL-7Rαγc binding compound provided by the present disclosure can be used in conjunction with a cancer vaccine or a viral vaccine.

Recent research suggests that IL-7 can serve as an effective vaccine adjuvant. For example, IL-7Rα is expressed on the majority of resting, naive CD8+ T cells; IL-7 signaling recruits T cells specific for low-affinity antigens into the proliferative pool in lymphopenic hosts; and, as with other Rγc cytokines, IL-7 prevents programmed cell death. Because IL-7 is important during the expansion and development of effector T-cells into memory T-cells, it is reasonable that IL-7 could be used to stimulate the development and expansion of effector T cells during vaccination.

Administration of IL-7 has been shown therapeutic potential for augmenting the immune response and can enhance the effectiveness of vaccine-induced T cell responses.

For example, co-delivery of hIL-7 DNA augmented multigenic HCV DNA vaccine-induced T cell responses in a non-human primate model.

In bacterial infections, therapeutic potential of IL-7 in the setting of sepsis mouse model was proven by increasing the number of recruited neutrophils.

Therapies involving administration of IL-7 showed enhanced virus-specific T cell responses which led to viral clearance in a chronic lymphocytic choriomeningitis (LCMV) mouse infection model. Administration of recombinant IL-7 during the contraction phase of CD8+ T cell responses elicited in response to DNA vaccines increased the number of LCMV-specific memory T-cells.

In a murine model of influenza A virus (IAV) it was demonstrated that a single intranasal pretreatment with Fc-fused IL-7 (IL-7-mFc), but not a native form of IL-7, protected mice from IAV-induced mortality for an extended period of time, even without preexisting IAV-specific immunity. IL-7-mFc treatment induced altered immune environments in the lung, with prolonged occupancy of lung-retentive effector/memory phenotype T (TRM-like) cells, which play an essential role in protection from IAVs by limiting viral replication and immunopathology, while helping IAV-specific cytotoxic T lymphocytes (CTLs) to propagate.

In another study, in which a recombinant RABV (rRABV) that expressed mouse IL-7 was administered to mice, it was found that overexpressing IL-7 improved the production of long-lasting primary and secondary antibody responses to RABV infection.

It has been reported that recombinant IL-7 protein enhances the survival of *Mycobacterium tuberculosis*-infected mice by the activation of antigen-specific effector CD8+ T cells.

Furthermore, IL-7-expressing plasmids can enhance vaccine-induced CTL and/or Th2-type immune responses in mice injected with HSV-2 gD DNA vaccine.

In another study a DNA vaccine encoding the VP1 capsid protein of foot and mouth disease virus was co-delivered to mice with an IL-6 expressing plasmid as an initial adjuvant and boosted with an IL-7 expressing plasmid as a secondary adjuvant. Mice immunized with pVAX-IL-6 and boosted with pVAX-IL-7 produced the highest expression of CD44high CD62Llow in activated CD4+ T cells.

IL-7Rαγc ligands and IL-7Rαγc ligand constructs provided by the present disclosure can be useful for cell therapy when engineered to be expressed on the membrane surface of cells that also express the IL-7Rαγc subunits. Adoptive immunotherapy using NK cells or using re-targeted chimeric antigen receptor (CAR) T-cells is currently being studied as a treatment for neoplasms and viral infections. One challenge with these cell therapies is the suboptimal sustained survival of the infused cells.

DNA encoding an IL-7Rαγc ligand fused to a membrane protein in such a way that the IL-7Rαγc ligand is expressed on the extracellular surface of a cell can be constructed using standard techniques. When the fusion protein comprising the IL-7Rαγc ligand is expressed, IL-7 receptors on the cell become activated leading to long-term persistence of the cell.

DNA encoding an IL-7Rαγc ligand can be incorporated into a cell and can be configured to produce an IL-7Rαγc ligand provided by the present disclosure. The IL-7Rαγc ligand can be secreted from the cell and can interact with the secreting cells (i.e., autocrine signaling) and/or cells in the vicinity of the secreting cell (i.e., paracrine signaling). A secreted IL-7Rαγc ligand or IL-7Rαγc ligand construct provided by the present disclosure can be an IL-7R agonist and can be designed to localize near the secreting cell.

An IL-7Rαγc ligand or IL-7Rαγc ligand construct provided by the present disclosure can be used to expand T-cells within a patient or within a biological sample. Methods of increasing the ratio of non-regulatory T-cells to Treg cells can comprise contacting a population of T-cells with an effective amount of an IL-7Rαγc ligand or IL-7Rαγc ligand construct. The ratio can be measured by determining the ratio of CD3+FOXP3+ cells to CD3+FOXP3-cells within the population of T-cells. A typical Treg frequency in human blood is 5% to 10% of the total CD4+CD3+ T-cells, however, in certain diseases this percentage may be lower or higher.

An IL-7Rαγc ligand or IL-7Rαγc ligand construct may be used to expand T-cells. T-cells modified with chimeric antigen receptors (CARs), which redirect immune cell activity to target cancer cells have been demonstrated to exhibit improved antitumor responses. CARs can comprise an antibody-derived extracellular domain, which binds to the desired tumor-associated antigen (TAA) and triggers an intracellular signaling cascade to activate the immune cell against the target cells.

An IL-7Rαγc ligand or IL-7Rαγc ligand construct that are immobilized to a surface can be exposed to populations of T-cells in vitro or ex vivo to induce expansion of the cell population. Prior to transfer to a patient. CAR-T cells can be expanded by exposure to an immobilized form of an IL-7Rαγc ligand or an IL-7Rαγc ligand construct. An immobilized IL-7Rαγc ligand or IL-7Rαγc ligand can be separated from the CAR-T cells prior to transfer of the CAR-T cells to a patient.

CAR T-cells can be genetically engineered to co-express a tethered form of an IL-7Rαγc ligand provided by the present disclosure to support in vivo persistence and maintenance of an immature state of differentiation and to exhibit in vivo antitumor activity.

Assessing single patient response to therapy and qualifying a patient for optimal therapy are among the greatest challenges of modern healthcare and relate to trends in personalized medicine. IL-7Rαγc binding compounds can have target selectivity, for example, for certain cancers and immune cells. IL-7Rαγc binding compounds radiolabeled for positron emission tomography (PET) or Single Photon Emission Computed Tomography (SPECT) can be used to predict the targeting of the treatment based on a single-study, case-by-case patient analysis thus excluding patients that are expected not to benefit from treatment. PET/SPECT scans using IL-7Rαγc binding compounds, once correlated to the concentration can provide a three-dimensional distribution map, which can then be used for macroscopic dose calculations.

IL-7Rαγc binding compounds can comprise one or more imaging agents. The IL-7Rαγc ligand can direct and localize the compound to cells, populations of cells, and tissue expressing IL-7R. The imaging compounds can comprise one or more imaging agents such as radiolabels, fluorescent labels, enzymatic labels, or PET imaging agents.

The imaging agents can be used to determine the number of cells expressing IL-7R, the expression level of cells expressing IL-7R, or properties of IL-7R such as the binding affinity of IL-7R to a particular IL-7Rαγc ligand and/or compound comprising an IL-7Rαγc ligand. The imaging agents can be used, for example, to evaluate cancer cells expressing IL-7Rα subunit, or to evaluate Treg and/or Teff cells.

The label can be detected to determine a biodistribution of the compound in a patient or to assess the potential for therapeutic efficacy. For example, tumors expressing high levels of IL-7R may be attractive targets for therapeutic IL-7Rαγc binding compounds provided by the present disclosure.

The imaging agents can be used to evaluate cells expressing IL-7R before therapy, during therapy, and/or following therapy.

Imaging agents comprising an IL-7Rαγc ligand can further comprise a moiety capable of binding to a cell surface and in particular to a protein expressed on the cell surface. The protein can be indicative of a certain cell type and is referred to as a cell surface marker. Imaging agents comprising both an IL-7Rαγc ligand and a cell surface marker can be used to assess cells, a population of cells, and/or a tissue expressing both IL-7R and the cell surface marker. Assessment can include determining the number of cells expressing both IL-7R and the cell surface marker, the expression levels of IL-7R and the cell surface marker, and/or the binding affinity of the imaging agent to IL-7R and/or the cell surface marker.

The imaging agents can be used to evaluate cells expressing IL-7R and the cell surface marker before therapy, during therapy, and/or following therapy.

Compounds provided by the present disclosure can be labeled. Labeled compounds can be useful in diagnostics.

IL-7Rαγc binding compounds provided by the present disclosure can be labeled with a detectable marker. The label can be used to determine a biodistribution of the compound in a patient or to assess the potential for therapeutic efficacy. For example, tumors expressing high levels of IL-7R may be attractive targets for selective IL-7R agonists and compounds comprising an IL-7Rαγc ligand provided by the present disclosure.

Thus, compounds provided by the present disclosure include labeled compounds. A labeled compound can be a detectable marker, for example, a radiolabeled amino acid or an attachment of biotinyl moieties to a polypeptide, wherein said attached biotinyl moieties can be detected by marked avidin (e.g., streptavidin containing a fluorescent marker or enzymatic activity that can be detected by optical or colorimetric methods). Various methods of labeling polypeptides and glycoproteins are known in the art and may be used. Examples of labels for polypeptides include, for example, a radioisotope such as, $^{3}H$, $^{14}C$, $^{35}S$, $^{125}I$, and $^{131}I$, a fluorescent labels such as FITC, rhodamine, and lanthanide phosphors, an enzymatic label such as horseradish peroxidase, β-galactosidase, luciferase, and alkaline phosphatase, biotinyl groups, predetermined polypeptide epitopes recognized by a secondary reporter such as leucine zipper pair sequences, binding sites for secondary antibodies, metal ligands, and epitope tags. A label can be attached by spacer arms of various lengths to reduce potential steric hindrance.

IL-7Rαγc binding compounds can comprise a cell-specific targeting moiety or molecule.

A cell-specific targeting moiety can comprise a moiety that has an affinity for a component on the surface of a cell such as a receptor, a protein, or an epitope. A moiety can comprise, for example, a ligand or an antibody having an affinity to a cell surface component.

The targeting moiety can direct and concentrate compounds comprising an IL-7Rαγc ligand at the cells, population of cells, or tissue targeted by the targeting moiety.

The targeting moiety can enhance the potency of IL-7R agonism or IL-7R antagonism for the cells or population of cells being targeted.

The targeting moiety can provide a differential response to IL-7R agonism or to IL-7R antagonism between the cells being targeted and the cells not being targeted by the targeting moiety.

The targeting moiety can provide a differential response to IL-7R agonism or IL-7R antagonism between cells having a high expression level of the targeted component and cells having a lower expression level of the targeted component.

IL-7Rαγc binding compounds can further comprise a bioactive moiety or a bioactive molecule. A compound comprising an IL-7Rα ligand can be used to deliver the bioactive moiety or bioactive molecule to cells, to a population of cells, or to a tissue expressing the IL-7Rα subunit.

The bioactive moiety or molecule can be non-cleavable and capable of exerting a biological activity when bound to the compound comprising an IL-7Rα ligand.

The bioactive moiety or molecule can be cleavable. The moiety can be cleavable by any suitable mechanism such as by pH, enzymatic, thermal, and/or electromagnetic mechanisms. Electromagnetic mechanisms include, for example, exposing the compounds to infrared, visible, or ultraviolet radiation, where the bioactive moiety is attached to the compounds comprising IL-7Rαγc ligand through a photolabile moiety capable of being cleaved by the radiation.

The bioactive molecule can be non-cleavable but otherwise activatable, such as for example, activatable by exposure to electromagnetic radiation.

IL-7Rαγc ligands can be selected to have enhanced binding to the IL-7Rα and/or Rγc subunit at a certain pH. For example, a pH-selective IL-7Rαγc ligand can have a greater binding affinity to the IL-7Rα and/or Rγc subunit at low pH commensurate with that of a solid tumor microenvironment. Compounds comprising low-pH selective IL-7Rαγc ligands can be used to preferentially activate cells in low pH environments expressing the IL-7Rα subunit compared to cells in normal pH environments associated with healthy tissue.

Thus, compounds comprising selective IL-7Rα and/or Rγc ligands such as pH-selective IL-7Rα and/or Rγc ligands can be used with other pH-selective bioactive moieties and molecules.

A bioactive moiety or bioactive molecule can itself be selective for a particular cell population. For example, a bioactive moiety or bioactive molecule can exhibit a greater or lesser binding affinity, potency, and/or activity at the cell being targeted by a selective IL-7Rα ligand. For example, the bioactive moiety or molecule can exhibit greater bioactivity in a low pH tumor microenvironment when targeted by a pH-selective an IL-7Rα ligand. In this example, the bioactive moiety is directed to cells located in the low-pH tumor microenvironment that express the IL-7Rα subunit by the pH-selective IL-7Rα ligand. Thus, the activity of the pH-selective bioactive moiety is enhanced in the low-pH tumor microenvironment.

Compounds comprising an IL-7Rα ligand can further comprise a cytotoxic moiety or cytotoxic molecule. Such compounds can be used to deliver a cytotoxic moiety or compound to a cell expressing the IL-7Rα subunit such as T-cells. The cytotoxic moiety or molecule can exert cytotoxicity when bound to the compound or can be cleavable and the moiety or molecule can be cytotoxic when released from the compound; or the cytotoxic moiety can be activated by electromagnetic radiation.

The cytotoxic moiety or molecule can be used to deplete cells expressing the IL-7Rα subunit being targeted.

IL-7Rαγc ligand-containing cytotoxic compounds can have more than one IL-7Rα ligand and thereby can exhibit a higher affinity and/or selectivity to cells, populations of cells, and tissue that highly express the IL-7Rα subunit compared to cells having a lower expression level of the IL-7Rα subunit.

IL-7Rαγc ligand-containing cytotoxic compounds can further include a cell surface targeting component. Such cytotoxic compounds can exhibit enhanced efficacy to cells, populations of cells, and tissue expressing the IL-7Rα subunit and the surface target component.

Examples of suitable cytotoxic molecules include antimicrotubule agents, alkylating agents, and DNA minor groove binding agents.

IL-7Rαγc binding compounds provided by the present disclosure can be used, for example, to treat diseases such as cancer, an inflammatory disease, an autoimmune disease, an immunodeficiency or an infectious disease, including a viral disease such as COVID-19.

An IL-7Rαγc binding compound provided by the present disclosure and pharmaceutical compositions of any of the foregoing may be administered to a patient to treat an organ transplant.

An IL-7Rαγc binding compound provided by the present disclosure and pharmaceutical compositions of any of the foregoing may be administered to a patient together with another compound for treating an inflammatory disease or an autoimmune disease in the subject. The at least one other therapeutic agent may be an IL-7Rαγc binding compound provided by the present disclosure. An IL-7Rαγc binding compound and the at least one other therapeutic agent may act additively or synergistically. The at least one additional therapeutic agent may be included in the same pharmaceutical composition or vehicle comprising the IL-7Rαγc binding compound or may be in a separate pharmaceutical composition or vehicle. Accordingly, methods provided by the present disclosure further include, in addition to administering an IL-7Rαγc binding compound, administering one or more therapeutic agents effective for treating an inflammatory disease or an autoimmune disease or a different disease, disorder or condition than an inflammatory disease or an autoimmune disease. Methods provided by the present disclosure include administration of an IL-7Rαγc binding compound and one or more other therapeutic agents provided that the combined administration does not inhibit the therapeutic efficacy of an IL-7Rαγc binding compound and/or does not produce adverse combination effects.

IL-7Rαγc binding compounds provided by the present disclosure comprise treating a disease in a patient such as cancer, an inflammatory disease, or an autoimmune disease comprising administering to a patient in need thereof a therapeutically effective amount of a compound capable of binding to the unique binding site of the IL-7Rα subunit and/or the Rγc subunit with an $IC_{50}$ of less than 100 μM, less than 10 μM, less than 1 μM, less than 100 nM, or less than 10 nM.

IL-7Rαγc binding compounds provided by the present disclosure may be used for treating cancer in a patient. The cancer can be, for example, a solid tumor or a metastasis.

IL-7Rαγc binding compounds provided by the present disclosure or a pharmaceutical composition thereof may be administered to treat a cancer known to be treated by activation of IL-7R. IL-7Rαγc binding compounds provided by the present disclosure or a pharmaceutical composition thereof may be administered to treat a cancer known to be treated by activation of the IL-7Rαγc subunits and where simultaneous activation of the IL-7Rα subunit compromises therapeutic efficacy and/or induces unwanted side effects.

IL-7Rαγc binding compounds provided by the present disclosure or pharmaceutical compositions thereof can be used to treat, for example, one or more of the following cancers: acute lymphoblastic leukemia, acute myeloid leukemia, adrenocortical carcinoma, appendix cancer, astrocytoma, atypical teratoid/rhabdoid tumor, basal cell carcinoma (nonmelanoma), B-cell lymphoma, bladder cancer, bone cancer, brain and spinal cord tumors, brain stem cancer, brain tumor, breast cancer, bronchial tumors, Burkitt lymphoma, carcinoid tumor, carcinoma of head and neck, central nervous system embryonal tumors, cerebellar astrocytoma, cerebral astrocytoma/malignant glioma, cervical cancer, chordoma, chronic lymphocytic leukemia, chronic myelogenous leukemia, colorectal cancer, craniopharyngioma, cutaneous T-cell lymphoma, desmoplastic small round cell tumor, ductal carcinoma, dye cancer, endocrine pancreas tumors (islet cell tumors), endometrial cancer, ependymoblastoma, esophageal cancer, esthesioneuroblastoma, Ewing family of tumors, extracranial germ cell tumor, extrahepatic bile duct cancer, gallbladder cancer, gastric cancer, gastrointestinal carcinoid tumor, gastrointestinal stromal tumor, gestational trophoblastic tumor, glioblastoma, glioma, hairy cell leukemia, head and neck cancer, heart cancer, hematopoetic tumors of the lymphoid lineage, hepatocellular cancer, Hodgkin lymphoma, hypopharyngeal cancer, hypothalamic and visual pathway glioma, IDs-related lymphoma, intraocular melanoma, islet cell tumors, Kaposi sarcoma, kidney cancer, Langerhans cell histiocytosis, laryngeal cancer, leukemia, lip and oral cavity cancer, male breast cancer, malignant fibrous histiocytoma, malignant germ cell tumors, malignant mesothelioma, medulloblastoma, melanoma, Merkel cell carcinoma, mesothelioma, mouth cancer, multiple endocrine neoplasia syndrome, multiple myeloma, mycosis fungoides, myelodysplastic, myeloproliferative neoplasms, nasal cavity and paranasal sinus cancer, nasopharyngeal cancer, neuroblastoma, non-Hodgkin lymphoma, non-small cell lung cancer, oral cancer, oropharyngeal cancer, osteosarcoma, ovarian cancer, ovarian epithelial cancer, ovarian germ cell tumor, ovarian low malignant potential tumor, pancreatic cancer, pancreatic neuroendocrine tumors (islet cell tumors), papillomatosis, paraganglioma, paranasal sinus and nasal cavity cancer, parathyroid cancer, penile cancer, pharyngeal cancer, pheochromocytoma, pineal parenchymal tumors, pineoblastoma and supratentorial primitive neuroectodermal tumors, pituitary tumor, plasma cell neoplasm/multiple myeloma, pleuropulmonary blastoma, pregnancy and breast cancer, primary central nervous system lymphoma, primary liver cancer, primary metastatic squamous neck cancer with occult, prostate cancer, rectal cancer, renal cell cancer, renal pelvis and ureter, respiratory tract carcinoma, retinoblastoma, rhabdomyosarcoma, salivary gland cancer, sarcoma, Sézary syndrome, skin cancer, small intestine cancer, soft tissue sarcoma, squamous cell carcinoma (nonmelanoma), stomach cancer, supratentorial primitive neuroectodermal tumors, T-cell lymphoma, testicular cancer, throat cancer, thymoma and thymic carcinoma, thyroid cancer, transitional cell cancer, urethral cancer, uterine sarcoma, vaginal cancer, visual pathway and hypothalamic glioma, vulvar cancer, Waldenström macroglobulinemia, Wilms tumor, and systemic and central metastases of any of the foregoing.

IL-7Rαγc binding compounds provided by the present disclosure or pharmaceutical compositions thereof can be used to treat solid tumors.

IL-7Rαγc binding compounds provided by the present disclosure or pharmaceutical compositions thereof can be used to treat tumor metastases.

IL-7Rαγc binding compounds provided by the present disclosure or pharmaceutical compositions thereof can be used to treat circulating tumor cells.

IL-7Rαγc binding compounds provided by the present disclosure or pharmaceutical compositions thereof can be used to treat, for example, a cancer selected from primary adult and childhood brain and CNS cancers including glioblastoma (GBM) and astrocytoma, skin cancers including melanoma, lung cancers including small cell lung cancers, non-small cell lung cancers (NSCLC), and large cell lung cancers, breast cancers including triple negative breast cancer (TNBC), blood cancers including myelodysplastic syndrome (MDS), multiple myeloma (MM), and acute myeloid leukemia (AML), prostate cancer including castrate resistant prostate cancer (CRPC), liver cancers including hepatocellular carcinoma (HCC), esophageal and gastric cancers, and any systemic and central metastases of any of the foregoing.

The amount of an IL-7Rαγc binding compound provided by the present disclosure, or pharmaceutical composition thereof that will be effective in the treatment of a cancer can depend, at least in part, on the nature of the disease, and may be determined by standard clinical techniques known in the art. In addition, in vitro or in vivo assays may be employed to help identify optimal dosing ranges. Dosing regimens and dosing intervals may also be determined by methods known to those skilled in the art. The amount of an IL-7Rαγc binding compound provided by the present disclosure administered may depend on, among other factors, the patient being treated, the weight of the patient, the severity of the disease, the route of administration, and the judgment of the prescribing physician.

For systemic administration, a therapeutically effective dose may be estimated initially from in vitro assays. Initial doses may also be estimated from in vivo data, e.g., animal models, using techniques that are known in the art. Such information may be used to more accurately determine useful doses in humans. One having ordinary skill in the art may optimize administration to humans based on animal data.

A dose of an IL-7Rαγc binding compound provided by the present disclosure and appropriate dosing intervals may be selected to maintain a sustained therapeutically effective concentration of the IL-7Rαγc binding compound provided by the present disclosure in the blood of a patient, and in certain embodiments, without exceeding a minimum adverse concentration.

A pharmaceutical composition comprising an IL-7Rαγc binding compound provided by the present disclosure may be administered, for example once per week, every 2 weeks, every 3 weeks, every 4 weeks, every 5 weeks, or every 6 weeks. Dosing may be provided alone or in combination with other drugs and may continue as long as required for effective treatment of the disease. Dosing may also be undertaken using continuous or semi-continuous administration over a period of time. Dosing includes administering a pharmaceutical composition to a mammal, such as a human, in a fed or fasted state.

A pharmaceutical composition may be administered in a single dosage form or in multiple dosage forms or as a continuous or an accumulated dose over a period of time. When multiple dosage forms are used the amount of an IL-7Rαγc binding compound provided by the present disclosure contained within each of the multiple dosage forms may be the same or different.

Suitable daily dosage ranges for administration can range, for example, from about 2 μg to about 200 mg of an IL-7Rαγc binding compound provided by the present disclosure per kilogram body weight.

Suitable daily dosage ranges for administration may range, for example, from about 1 μg to about 50 mg of an IL-7Rαγc binding compound provided by the present disclosure per square meter ($m^2$) of body surface.

An IL-7Rαγc binding compound provided by the present disclosure may be administered to treat cancer in a patient in an amount, for example, from 0.001 mg/day to 100 mg/day, or in any other appropriate daily dose. A dose can be, for example, from 0.01 μg/kg body weight/week to 100 μg/kg body weight/week or any other suitable dose.

A pharmaceutical composition comprising an IL-7Rαγc binding compound provided by the present disclosure may be administered to treat cancer in a patient so as to provide a therapeutically effective concentration of an IL-7Rαγc binding compound provided by the present disclosure in the blood or plasma of the patient. A therapeutically effective concentration of a compound of an IL-7Rαγc binding compound provided by the present disclosure in the blood of a patient can be, for example, from 0.01 μg/L to 1,000 μg/L, from 0.1 μg/L to 500 μg/L, from 1 μg/L to 250 μg/L, or from about 10 μg/L to about 100 μg/L. A therapeutically effective concentration of an IL-7Rαγc binding compound provided by the present disclosure in the blood of a patient can be, for example, at least 0.01 μg/L, at least 0.1 μg/L, at least 1 μg/L, at least about 10 μg/L, or at least 100 μg/L. A therapeutically effective concentration of an IL-7Rαγc binding compound in the blood of a patient can be, for example, less than an amount that causes unacceptable adverse effects including adverse effects to homeostasis. A therapeutically effective concentration of an IL-7Rαγc binding compound in the blood of a patient can be an amount sufficient to restore and/or maintain homeostasis in the patient.

Pharmaceutical compositions comprising an IL-7Rαγc binding compound may be administered to treat a disease in a patient so as to provide a therapeutically effective concentration of the IL-7Rαγc binding compound in the blood of a patient for an extended period of time such as, for example, for at least 1 day, for at least 1 week, at least 2 weeks, at least 4 weeks, at least 5 week, or at least 6 weeks.

The amount of an IL-7Rαγc binding compound administered may vary during a treatment regimen.

Pharmaceutical compositions provided by the present disclosure may further comprise one or more pharmaceutically active compounds in addition to an IL-7Rαγc binding compound provided by the present disclosure. Such compounds may be provided, for example, to treat the cancer being treated with the IL-7Rαγc binding compound or to treat a disease, disorder, or condition other than the cancer being treated with the IL-7Rαγc binding compound, to treat a side-effect caused by administering the IL-7Rαγc binding compound, to augment the efficacy of the IL-7Rαγc binding compound, and/or to modulate the activity of the IL-7Rαγc binding compound.

An IL-7Rαγc binding compound provided by the present disclosure may be used in combination with at least one other therapeutic agent. An IL-7Rαγc binding compound may be administered to a patient together with another compound for treating cancer in the patient. The at least one other therapeutic agent can be a second, different IL-7Rαγc binding compound. An IL-7Rαγc binding compound and the at least one other therapeutic agent may act additively or, and in certain embodiments, synergistically with another IL-7Rαγc binding compound. The at least one additional therapeutic agent may be included in the same pharmaceutical composition or vehicle comprising the IL-7Rαγc binding compound or may be in a separate pharmaceutical composition or vehicle. Accordingly, methods provided by the present disclosure further include, in addition to administering an IL-7Rαγc binding compound, administering one or more therapeutic agents effective for treating cancer or a different disease, disorder or condition than cancer. Methods provided by the present disclosure include administration of an IL-7Rαγc binding compound and one or more other therapeutic agents provided that the combined administration does not inhibit the therapeutic efficacy of the IL-7Rαγc binding compound and/or does not produce adverse combination effects.

A pharmaceutical composition comprising an IL-7Rαγc binding compound may be administered concurrently with the administration of another therapeutic agent, which may be part of the same pharmaceutical composition as, or in a different pharmaceutical composition than that comprising an IL-7Rαγc binding compound. An IL-7Rαγc binding compound may be administered prior or subsequent to administration of another therapeutic agent. In certain combination therapies, the combination therapy may comprise alternating between administering an IL-7Rαγc binding compound and a composition comprising another therapeutic agent, e.g., to minimize adverse drug effects associated with a particular drug. When an IL-7Rαγc binding compound is administered concurrently with another therapeutic agent that potentially may produce an adverse drug effect including, for example, toxicity, the other therapeutic agent may be administered at a dose that falls below the threshold at which the adverse drug reaction is elicited.

A pharmaceutical composition comprising an IL-7Rαγc binding compound provided by the present disclosure may be administered with one or more substances, for example, to enhance, modulate and/or control release, bioavailability, therapeutic efficacy, therapeutic potency, and/or stability, of the IL-7Rαγc binding compound. For example, a pharmaceutical composition comprising an IL-7Rαγc binding compound can be co-administered with an active agent having pharmacological effects that enhance the therapeutic efficacy of the IL-7Rαγc binding compound.

An IL-7Rαγc binding compound, or a pharmaceutical composition thereof may be administered in conjunction with an agent known or believed to be effective in treating a disease such as cancer, an autoimmune disease or an inflammatory disease in a patient, such as the same disease being treated with the IL-7Rαγc binding compound.

An IL-7Rαγc binding compound, or a pharmaceutical composition thereof may be administered in conjunction with an agent known or believed to interfere with cell proliferation.

An IL-7Rαγc binding compound, or a pharmaceutical composition thereof may be administered in conjunction with an agent known or believed to interfere with cellular metabolism, to be an anti-metabolite, to interfere with RNA transcription, to interfere with RNA translation, to interfere with cellular protein synthesis, to interfere with synthesis of precursors for DNA synthesis and replication, to interfere with purine synthesis, to interfere with nucleoside synthesis, to interact with mTOR, to be an mTOR inhibitor, to interfere with cell cycle checkpoints.

An IL-7Rαγc binding compound or a pharmaceutical composition thereof may be administered in conjunction with a checkpoint inhibitor including a CTLA-4 inhibitor such as ipilimumab, a PD-1 inhibitor such as pembrolizumab and nivolumab, and/or a PD-LI inhibitor such as atezolizumab, avelumab, and durvalumab. An IL-7Rαγc binding compound or a pharmaceutical composition thereof may be administered in conjunction with an immunomodulator such as CD137/4-1BB, CD27, GIYR, and/or OC40.

An IL-7Rαγc binding compound or a pharmaceutical composition thereof may be administered in conjunction with an agent known or believed to be cytotoxic, to cause DNA damage, to cause cell cycle arrest, or to cause mitotic catastrophe.

An IL-7Rαγc binding compound or a pharmaceutical composition thereof may be administered in conjunction with an agent known or believed to modulate glutathione concentration, to modulate glutathione concentration within cells, to decrease glutathione concentration within cells, to reduce glutathione uptake into cells, to reduce glutathione synthesis, or to reduce glutathione synthesis within cells.

An IL-7Rαγc binding compound or a pharmaceutical composition thereof may be administered in conjunction with an agent known or believed to interfere with neovascularization, to reduce neovascularization, or to promote neovascularization.

An IL-7Rαγc binding compound or a pharmaceutical composition thereof may be administered in conjunction with an agent known or believed to interfere with hormone homeostasis, to interfere with hormone synthesis, to interfere with hormone receptor binding, or to interfere with hormone signal transduction.

An IL-7Rαγc binding compound or a pharmaceutical composition thereof may be administered in conjunction with an agent known or believed to interfere with growth factor homeostasis, to interfere with growth factor receptor expression, to interfere with growth factor binding to growth factor receptors, to interfere with growth factor receptor signal transduction, to interfere with the Hedgehog (Hh) signaling, to inhibit the Hedgehog pathway signaling, to inhibit ALK (anaplastic lymphoma kinase) pathway signaling, or to inhibit the non-homologous end joining (NHEJ) pathway.

An IL-7Rαγc binding compound or a pharmaceutical composition thereof may be administered in conjunction with one or more agents known or believed to be a VEGFR (vascular endothelial growth factor receptor) inhibitor, a RTK (receptor tyrosine kinase) inhibitor, a sodium channel current blocker, aFAK (focal adhesion kinase) inhibitor, a GLI (glioma-associated oncogene) inhibitor, a GLI1 inhibitor, a GLI2 inhibitor, a GLI3 inhibitor, a MAPK (mitogen-activated protein kinase) inhibitor, a MAPK/ERK pathway (also known as Ras-Raf-MEK-ERK pathways) inhibitor, a MEK1 inhibitor, a MEK2 inhibitor, a MEK5 inhibitor, a MEK5/ERK5 inhibitor, aRTA (renal tubular acidosis) inhibitor, a ALK (anaplastic lymphoma kinase) inhibitor, Aa LK kinase inhibitor, a nuclear translocation inhibitor, a PORCN (porcupine) inhibitor, a 5-ARI (5α-reductase inhibitor), topoisomerase inhibitor, a Ras (rat sarcoma) inhibitor, a K-ras inhibitor, a CERK (ceramide kinase) inhibitor, a PKB (protein kinase B, also known as AKT) inhibitor, a AKT1 inhibitor, EZH2 (enhancer of zeste homolog 2) inhibitor, a BET (bromodomain and extraterminal domain motif) inhibitor, a SYK (spleen tyrosine kinase) inhibitor, JAK (janus kinase) inhibitors, a SYK/JAK inhibitor, a IDO (indoleamine-pyrrole 2,3-dioxygenase) inhibitor, a IDO1 inhibitor, a RXR (retinoic X receptors) activating agent, a selective RXR activating agent, a p-glycoprotein inhibitor, a ERK inhibitor, a PI3K (phosphatidylinositol-4,5-bisphosphate 3-kinase) inhibitor, a BRD (bromodomain-containing protein) inhibitor, a BRD2 inhibitor, a BRD3 inhibitor, a BRD4 inhibitor, a BRDT (bromodomain testis-specific protein) inhibitor, a reverse transcriptase inhibitor, a NRT (nucleoside analog reverse-transcriptase) inhibitor, a PIM (proviral integrations of moloney virus) inhibitor, a EGFR (epidermal growth factor receptor) inhibitor, a photosensitizer, a radiosensitizer, a ROS (proto-oncogene, receptor tyrosine kinase) inhibitor, a ROS1 (proto-oncogene 1) inhibitor, a CK (casein kinase) inhibitor, a CK2 inhibitor, a Bcr-Abl (breakpoint cluster region—Abelson proto-oncogene) tyrosine-kinase inhibitor such as dasatinib, a microtubule stabilizing agent, a microtubule depolymerization/disassembly inhibitor, a DNA intercalator, an androgen receptor antagonist, a chemoprotective agents, a HDAC (histone deacetylase) inhibitor, a DPP (dipeptidyl peptidase) inhibitor, a DPP-4 inhibitor, BTK (Bruton's tyrosine kinase) inhibitor, a kinase inhibitor such as imatinib, a tyrosine kinase inhibitor such as nilotinib, a ARP (poly (ADP-ribose) polymerase) inhibitor, a CDK (cyclin-dependent kinase) inhibitor, a CDK4 inhibitor, a CDK6 inhibitor, a CDK4/6 inhibitor, a HIF1α (hypoxia-inducible factor 1-α) inhibitor, a DNA ligase inhibitor, a DNA ligase IV inhibitor, a NHEJ (non-homologous end joining) inhibitor, a DNA ligase IV, a NHEJ inhibitor and a RAF inhibitor, a TKI and a RAF inhibitor, a TKI and RAF inhibitor such as sorafenib, a PDT (photodynamic therapy) sensitizer, an ATR (ataxia telangiectasia- and Rad3-related protein kinase) inhibitor, or a combination of any of the foregoing.

An IL-7Rαγc binding compound or a pharmaceutical composition thereof may be administered in conjunction with one or more chemotherapeutic agents, such as, for example, a VEGFR inhibitor such as fruquintinib, motesanib/AMG-706, vatalanib; a RTK inhibitor such as ponatinib; a sodium channel blocker such as GS967; a FAK inhibitor such as TAE226; a GLI1 and GLI2 inhibitor such as GANT61, a MEK inhibitor such as binimetinib; a RTA inhibitor such as linifanib; an ALK inhibitor such as brigstinib; bromopyruvic acid; a DNA alkylating agent such as thiotepa; nuclear translocations factors such as JSH-23; a PORCn inhibitor such as Wnt-C59; a 5α-reductase inhibitor such as dutasteride; a topoisomerase inhibitor such as carubicin; a RAS inhibitor such as Kobe0065; a CerK inhibitor such as NVP-231; an AKT inhibitor such as uprosertib; a EZH2 inhibitor such as GSK-503; a BET bromodomain inhibitor such as OTX015; a MEK5/ERK5 inhibitor such as BIX02189; a Syl/JAK inhibitor such as cerdulatinib; an IDO1 inhibitor such as NLG919; a retinoic X receptor activating agent such as bexsrotene; a PGP inhibitor such as acotiamide or actotiamide HCl; an Erk inhibitor such SCH772984; a PI3K inhibitor such as gedatolisib; a JAK inhibitor such as ruxolitinib; an AKT inhibitor such as afuresertib or afuresertib HCl; an ALK1 inhibitor such as ceritinib; an HDAC inhibitor such as abexinostat; a DPP inhibitor such as oamarigliptin; an EGFR inhibitor such as gefittinib; an EZH2 inhibitor such as GSK126; a BTK inhibitor such as ibrutinib; a kinase inhibitor such as imatinin HCl; an IDO inhibitor such as INCB024360; a DNA crosslinker such as mitomycin C; a tyrosine kinase inhibitor such as nilotinib, a PARP inhibitor such as olaparib; a tubulin stabilization promoter such as paclitaxel; a CDK4/6 inhibitor such as palbociclib; a RTK inhibitor such as sunitinib; a PDT sensitizer such as tslsporfin; a p-glycoprotein inhibitor such as tariquidar; an ATR inhibitor such as VE-822; an HDAC inhibitor such as PCI-24781; a DPP inhibitor such as omarigliptin; an EGFR inhibitor such as gefinib; an EZH2 inhibitor such as GSK126; a BTK inhibitor such as irbrutinib; an IDO inhibitor such as INCB024360; or a combination of any of the foregoing.

For example, an IL-7Rαγc binding compound or a pharmaceutical composition thereof may be administered in conjunction with another chemotherapeutic agent, such as, for example, N-acetyl cysteine (NAC), adriamycin, alemtuzumab, amifostine, arsenic trioxide, ascorbic acid, bendamustine, bevacizumab, bortezomib, busulfan, buthionine sulfoxime, carfilzomib, carmustine, clofarabine, cyclophosphamide, cyclosporine, cytarabine, dasatinib, datinomycin, defibrotide, dexamethasone, docetaxel, doxorubicin, etoposide, filgrastim, floxuridine, fludarabine, gemcitabine, interferon alpha, ipilimumab, lenalidomide, leucovorin, melphalan, mycofenolate mofetil, paclitaxel, palifermin, panobinostat, pegfilrastim, prednisolone, prednisone, revlimid, rituximab, sirolimus, sodium 2-mercaptoethane sulfonate (MESNA), sodium thiosulfate, tacrolimus, temozolomide, thalidomide, thioguanine, thiotepa, topotecan, velcade, or a combination of any of the foregoing.

An IL-7Rαγc binding compound or a pharmaceutical compositions thereof can be used in combination therapy with other chemotherapeutic agents including one or more antimetabolites such as folic acid analogs; pyrimidine analogs such as fluorouracil, floxuridine, and cytosine arabinoside; purine analogs such as mercaptopurine, thiogunaine, and pentostatin; natural products such as vinblastine, vincristine, etoposide, tertiposide, dactinomycin, daunorubicin, doxorubicin, bleomycin, mithamycin, mitomycin C, L-asparaginase, and interferon alpha; platinum coordination complexes such as cis-platinum, and carboplatin; mitoxantrone; hydroxyurea; procarbazine; hormones and antagonists such as prednisone, hydroxyprogesterone caproate, medroxyprogesterone acetate, megestrol acetate, diethylstilbestrol, ethinyl estradiol, tamoxifen, testosterone propionate, fluoxymesterone, flutamide, and leuprolide, anti-angiogenesis agents or inhibitors such as angiostatin, retinoic acids, paclitaxel, estradiol derivatives, and thiazolopyrimidine derivatives; apoptosis prevention agents; triptolide; colchicine; luliconazole; and radiation therapy.

An IL-7Rαγc binding compound or a pharmaceutical composition thereof may be co-administered with a compound that inhibits DNA repair such as, for example, 06-benzylguanine (06-BG).

An IL-7Rαγc binding compound or a pharmaceutical composition thereof may be administered in conjunction with one or more chemotherapeutic agents, such as, for example, abarelix, abiraterone, abiraterone acetate, n-acetyl cysteine, aclarubicin hydrochloride, adriamycin, adenine, afatinib, afatinib dimaleate, alemtuzumab, alendronate sodium, alitretinoin, allopurinol sodium, altretamine, amifostine, aminoglutethimide, aminolevulinic acid, amrubicin, amsacrine, anastrozole, angiostatin, apremilast, aprepitant, arsenic trioxide, ascorbic acid, l-asparaginase, azacitidine, azathioprine sodium, bazedoxifene (serm), belinostat, bendamustine hcl, 06-benzylguanine, bevacizumab, bexarotene, bicalutamide, biricodar, bleomycin sulfate, bortezomib, bosutinib, brivudine, buserelin, busulfan, buthionine sulfoxime, cabazitaxel, cabozantinib, capecitabine, carboplatin, carboquone, carfilzomib, carmofur, carmustine, ceritinib, chlorambucil, cisplatin, cladribine, clodronate disodium, clofarabine, crizotinib, cyclophosphamide, cyclosporine, cytarabine, cytosine arabinoside, dabrafenib, dacarbazine, dactinomycin, dasatinib, datinomycin, daunorubicin, decitabine, defribrotide, degarelix acetate, dexamethasone, dexrazoxane hydrochloride, diaziquone, diethyl stilbestrol, docetaxel, doxifluridine, doxorubicin hydrochloride, doxorubicin free base, dromostanolone propionate, dutasteride, eltrombopag, enzalutamide, epirubicin hydrochloride, eribulin mesylate, erlotinib hydrochloride, estramustine phosphate sodium, ethinyl estradiol, etoposide phosphate, etoposide, everolimus, exemestane, fentanyl, filgrastim, fingolimod, floxuridine, fludarabine phosphate, fluorouracil, fluoxymesterone, flutamide, formestane, formylmelphalan, fosaprepitant, fotemustine, fulvestrant, gefitinib, gemcitabine hydrochloride, gemcitabine free base, glutathione, glyciphosphoramide, glyfosfin, goserelin acetate, granisetron hydrochloride, heptaplatin, hexyl 5-aminolevulinate, histrelin acetate, hydroxyprogesterone caproate, hydroxyurea, ibandronate sodium, ibrutinib, icotinib, idarubicin HCl, idelalisib, idoxuridine, ifosfamide, interferon alpha, imatinib mesylate, imiquimod, ingenol mebutate, ipilimumab, irinotecan hydrochloride, ixabepilone, lanreotide acetate, lapatinib free base, lapatinib ditosylate, lasofoxifene, lenalidomide, letrozole, leucovorin calcium, leuprolide acetate, levamisole hydrochloride, levoleucovorin calcium, iobenguane, lobaplatin, lomustine, maropitant, masoprocol, mechlorethamine hydrochloride, megestrol acetate, medroxyprogesterone acetate, melphalan hydrochloride, mercaptopurine, mercaptoethane sulfonate sodium, methotrexate, methoxsalen, methyl aminolevulinate, methylene blue, methylisoindigotin, mifamurtide, miltefosine, miriplatin, mithamycin, mitobronitol, mitomycin C, mitotane, mitoxantrone hydrochloride, mycophenolate mofetil, nabiximols, nafarelin, nandrolone, nedaplatin, nelarabine, netupitant, nilotinib, nilutamide, nimustine, nintedanib, nocodazole, octreotide, olaparib, omacetaxine mepesuccinate, ondansetron hydrochloride, oxaliplatin, paclitaxel, palbociclib, palifermin, palonosetron hydrochloride, pamidronate disodium, panobinostat, pasireotide, pazopanib hydrochloride, pegfilrastim, pemetrexed disodium, pentostatin, peplomycin, pipobroman, pirarubicin, plerixafor, plicamycin, pomalidomide, ponatinib, porfimer sodium, porfiromycin, pralatrexate, prednimustine, prednisolone, prednisone, procarbazine hydrochloride, quinagolide hydrochloride, raloxifene, raltitrexed, radotinib, ranimustine, retinoic acids, revlimid, rituxinab, romidepsin, ruxolitinib, ruxolitinib phosphate, semustine, sirolimus, sodium thiosulfate, sorafenib free base, sorafenib tosylate, streptozocin, sufentanil, sunitinib, tacrolimus, talaporfin sodium, tamibarotene, tamoxifen citrate, tapentadol, temoporfin, temozolomide, temsirolimus, teniposide, teriflunomide, tertiposide, testolactone, testosterone propionate, thalidomide, thioguanine, thiotepa, thymalfasin, toceranib phosphate, topotecan hydrochloride, toremifene citrate, trabectedin, trametinib, tretinoin, trilostane, triptorelin, tropisetron, uramustine, valrubicin, vandetanib, vedotin, vemurafenib, verteporfin, vinblastine, vincristine sulfate, vincristine free base, vindesine, vinorelbine tartrate, vorinostat, and zoledronic acid.

An IL-7Rαγc binding compound or a pharmaceutical composition thereof may be administered in conjunction with one or more chemotherapeutic agents such as, for example, abemaciclib, abiraterone acetate, ABVD, ABVE, ABVE-PC, AC, acalabrutinib, AC-T, ADE, ado-trastuzumab emtansine, afatinib dimaleate, aldesleukin, alectinib, alemtuzumab, alpelisib, amifostine, aminolevulinic acid hydrochloride, anastrozole, apalutamide, aprepitant, arsenic trioxide, asparaginase *Erwinia chrysanthemi*, atezolizumab, avelumab, axicabtagene ciloleucel, axitinib, azacitidine, BEACOPP, belinostat, bendamustine hydrochloride, BEP, bevacizumab, bexarotene, bicalutamide, binimetinib, bleomycin sulfate, blinatumomab, bortezomib, bosutinib, brentuximab vedotin, brigatinib, BuMel, busulfan, cabazitaxel, cabozantinib-s-malate, CAF, calaspargase pegol-mknl, capecitabine, caplacizumab-yhdp, CAPOX, carboplatin, carboplatin-taxol, carfilzomib, carmustine, carmustine implant, CEM, cemiplimab-rwlc, ceritinib, cetuximab, CEV, chlorambucil, chlorambucil-prednisone, CHOP, cisplatin, cladribine, clofarabine, CMF, cobimetinib, copanlisib hydrochloride, COPDAC, COPP, COPP-ABV, crizotinib, CVP, cyclophosphamide, cytarabine, cytarabine liposome, dabrafenib mesylate, dacarbazine, dacomitinib, dactinomycin, daratumumab, darbepoetin a, dasatinib, daunorubicin hydrochloride, daunorubicin hydrochloride and cytarabine liposome, decitabine, defibrotide sodium, degarelix, denileukin diftitox, denosumab, dexamethasone, dexrazoxane hydrochloride, dinutuximab, docetaxel, doxorubicin hydrochloride, doxorubicin hydrochloride liposome, durvalumab, duvelisib, elotuzumab, eltrombopag olamine, emapalumab-lzsg, enasidenib mesylate, encorafenib, enzalutamide, epirubicin hydrochloride, EPOCH, epoetin alfa, erdafitinib, eribulin mesylate, erlotinib hydrochloride, etoposide, etoposide phosphate, everolimus, exemestane, fee, filgrastim, fludarabine phosphate, fluorouracil injection, fluorouracil—topical, flutamide, folfiri, folfiri-bevacizumab, folfiri-cetuximab, folfirinox, folfox, fostamatinib disodium, FU-LV, fulvestrant, gefitinib, gemcitabine hydrochloride, gemcitabine-cisplatin, gemcitabine-oxaliplatin, gemtuzumab ozogamicin, gilteritinib fumarate, glasdegib maleate, glucarpidase, goserelin acetate, granisetron, HPV bivalent vaccine, HPV bivalent vaccine, recombinant HPV nonavalent vaccine, HPV nonavalent vaccine, recombinant, HPV quadrivalent vaccine, HPV uadrivalent vaccine recombinant, hydroxyurea, hyper-CVAD, ibritumomab tiuxetan, ibrutinib, ICE, idarubicin hydrochloride, idelalisib, ifosfamide, imatinib mesylate, imiquimod, inotuzumab ozogamicin, interferon α-2b recombinant, iobenguane I$^{131}$, ipilimumab, irinotecan hydrochloride, irinotecan hydrochloride liposome, ivosidenib, ixabepilone, ixazomib citrate, JEB, lanreotide acetate, lapatinib ditosylate, larotrectinib sulfate, lenalidomide, lenvatinib mesylate, letrozole, leucovorin calcium, leuprolide acetate, lomustine, lorlatinib, lutetium Lu 177-dotatate, mechlorethamine hydrochloride, megestrol acetate, melphalan, melphalan hydrochloride, mercaptopurine, mesna, methotrexate, methylnaltrexone bromide, midostaurin, mitomycin c, mitoxantrone hydrochloride, mogamulizumab-kpkc, moxetumomab pasudotox-tdfk, MVAC, necitumumab, nelarabine, neratinib maleate, netupitant and palonosetron hydrochloride, nilotinib, nilutamide, niraparib tosylate monohydrate, nivolumab, obinutuzumab, OEPA, ofatumumab, OFF, olaparib, olaratumab, omacetaxine mepesuccinate, ondansetron hydrochloride, OPPA, osimertinib mesylate, oxaliplatin, paclitaxel, paclitaxel albumin-stabilized nanoparticle formulation, PAD, palbociclib, palifermin, palonosetron hydrochloride, palonosetron hydrochloride and netupitant, pamidronate disodium, panitumumab, panobinostat, pazopanib hydrochloride, PCV, PEB, pegaspargase, pegfilgrastim, peginterferon α-2b, pembrolizumab, pemetrexed disodium, pertuzumab, plerixafor, polatuzumab vedotin-piiq, pomalidomide, ponatinib hydrochloride, pralatrexate, prednisone, procarbazine hydrochloride, propranolol hydrochloride, radium 223 dichloride, raloxifene hydrochloride, ramucirumab, rasburicase, ravulizumab-cwvz, R-CHOP, R-CVP, recombinant HPV bivalent vaccine, recombinant HPV nonavalent vaccine, recombinant HPV quadrivalent vaccine, recombinant interferon α-2b, regorafenib, R-EPOCH, ribociclib, R-ICE, rituximab, rituximab and hyaluronidase human, rolapitant hydrochloride, romidepsin, romiplostim, rucaparib camsylate, ruxolitinib phosphate, siltuximab, sipuleucel-t, sonidegib, sorafenib tosylate, STANFORD V, sunitinib malate, TAC, tagraxofusp-erzs, talazoparib tosylate, talc, talimogene laherparepvec, tamoxifen citrate, temozolomide, temsirolimus, thalidomide, thioguanine, thiotepa, tisagenlecleucel, tocilizumab, topotecan hydrochloride, toremifene, TPF, trabectedin, trametinib, trastuzumab, trastuzumab and hyaluronidase-oysk, trifluridine and tipiracil hydrochloride, uridine triacetate, VAC, Valrubicin, VAMP, vandetanib, VeIP, vemurafenib, venetoclax, vinblastine sulfate, vincristine sulfate liposome, vinorelbine tartrate, vip, vismodegib, vorinostat, XELIRI, XELOX, Ziv-aflibercept, zoledronic acid, and combinations of any of the foregoing.

The efficacy of administering an IL-7Rαγc binding compound or a pharmaceutical composition thereof for treating cancer may be assessed using in vitro and animal studies and in clinical trials.

The suitability of an IL-7Rαγc binding compound or a pharmaceutical composition thereof in treating cancer may be determined by methods described in the art.

An IL-7Rαγc binding compound or a pharmaceutical composition thereof can be useful in treating inflammatory diseases.

An IL-7Rαγc binding compound or a pharmaceutical composition thereof may be administered to a patient in need of such treatment to treat an inflammatory disease.

Examples of inflammatory diseases include allergy, Alzheimer's disease, anemia, ankylosing spondylitis, arthritis, atherosclerosis, asthma, autism, arthritis, carpal tunnel syndrome, celiac disease, colitis, Crohn's disease, congestive heart failure, dermatitis, diabetes, diverticulitis, eczema, fibromyalgia, fibrosis, gall bladder disease gastroesophageal reflux disease, Hashimoto's thyroiditis, heart attack, hepatitis, irritable bowel syndrome, kidney failure, lupus, multiple sclerosis, nephritis, neuropathy, pancreatitis, Parkinson's disease, psoriasis, polymyalgia rheumatica, rheumatoid arthritis, scleroderma, stroke, surgical complications, and ulcerative colitis.

An IL-7Rαγc binding compound or a pharmaceutical composition thereof can be useful in treating autoimmune diseases. Autoimmune diseases can be defined as human diseases in which the immune system attacks its own proteins, cells, and/or tissues. A comprehensive listing and review of autoimmune diseases can be found, for example, in The Autoimmune Diseases, Rose and Mackay, 2014, Academic Press.

An IL-7Rαγc binding compound or a pharmaceutical composition thereof may be administered to a patient in need of such treatment to treat an autoimmune disease.

Examples of autoimmune diseases include Addison's disease, agammaglobulinemia, alopecia areata, amyloidosis, ankylosing spondylitis, anti-GBM/anti-TBN nephritis, antiphospholipid syndrome, autoimmune angioedema, autoimmune dysautonomia, autoimmune encephalomyelitis, autoimmune hepatitis, autoimmune inner ear disease, autoimmune myocarditis, autoimmune pancreatitis, autoimmune retinopathy, autoimmune urticaria, axonal and neuronal neuropathy, Balo's disease, Bechet's disease, benign mucosal pemphigoid, bullous pemphigoid, Castleman disease, celiac disease, Chagas disease, chronic inflammatory demyelinating polyneuropathy, chronic recurrent multifocal osteomyelitis, Churg-Strauss, cicatricial pemphigoid, Cogan's syndrome, cold agglutinin disease, congenital heart block, Coxsackie myocarditis, CREST syndrome, Crohn's disease, dermatitis herpetiformis, dermatomyositis, Devic's disease, discoid lupus, Dressler's syndrome, endometriosis, eosinophilic esophagitis, eosinophilic fasciitis, erythema nodosum, essential mixed cryoglobulinemia, Evans syndrome, fibromyalgia, fibrosing alveolitis, giant cell arteritis, giant cell myocarditis, glomerulonephritis, Goodpasture's syndrome, granulomatosis with polyangiitis, Graves' disease, Guillain-Barre syndrome, Hashimoto's thyroiditis, hemolytic anemia, Henoch-Schonlein purpura, herpes gestationis or pemphigoid gestationis, hypogammaglobulinemia, IgA nephropathy, IgG4-related sclerosing disease, immune thrombocytopenic purpura, inclusion body myositis, interstitial cystitis, juvenile arthritis, juvenile diabetes, juvenile myositis, Kawasaki disease, Lambert-Eaton syndrome, leukocytoclastic vasculitis, lichen planus, lichen sclerosis, ligneous conjunctivitis, linear IgA disease, lupus, Lyme disease chronic, Meniere's diseases, microscopic polyangiitis, mixed connective tissue disease, Mooren's ulcer, Mucha-Habermann disease, multiple sclerosis, myasthenia gravis, myositis, narcolepsy, neuromyelitis, optica, neutropenia, ocular cicatricial pemphigoid, optic neuritis, palindromic rheumatism, PANDAS, paraneoplastic cerebellar degeneration, paroxysmal nocturnal hemoglobinuria, Parry Romberg syndrome, pars planitis, Parsonage-Turner syndrome, pemphigus, peripheral neuropathy, perivenous encephalomyelitis, pernicious anemia, POEMS syndrome, polyarteritis nodosa, polyglandular syndromes, polymyalgia rheumatica, polymyositis, postmyocardial infarction syndrome, postpericardiotomy syndrome, primary biliary cirrhosis, primary sclerosing cholangitis, progesterone dermatitis, psoriasis, psoriatic arthritis, pure red cell aplasia, pyoderma gangrenosum, Raynaud's phenomenon, reactive arthritis, reflex sympathetic dystrophy, relapsing polychondritis, restless legs syndrome, retroperitoneal fibrosis, rheumatic fever, rheumatoid arthritis, sarcoidosis, Schmidt syndrome, scleritis, scleroderma, Sjogren's syndrome, sperm and testicular autoimmunity, stiff person syndrome, subacute bacterial endocarditis, Susac's syndrome, sympathetic ophthalmia, Takayasu's arteritis, temporal arteritis, thrombocytopenic purpura, Tolosa-Hunt syndrome, transverse myelitis, type 1 diabetes, ulcerative colitis, undifferentiated connective tissue disease, uveitis, vasculitis, vitiligo, and Wegener's granulomatosis.

An IL-7Rαγc binding compound or a pharmaceutical composition thereof can be used to treat autoimmune disorders such as, for example, lupus, graft-versus-host disease, hepatitis C-induced vasculitis, Type I diabetes, multiple sclerosis, spontaneous loss of pregnancy, atopic diseases, and inflammatory bowel diseases.

An IL-7Rαγc binding compound can be administered with one or more additional therapeutic agents for treating an autoimmune disease. An IL-7Rαγc binding compound or a pharmaceutical composition thereof may be administered in conjunction with one or more immunosuppressants including, for example, corticosteroids such as prednisone, budesonide, and prednisolone; Janus kinase inhibitors such as tofacitinib; calcineurin inhibitors such as cyclosporine and tacrolimus; mTOR inhibitors such as sirolimus and everolimus; IMDH inhibitors such as azathioprine, leflunomide, and mycophenolate; biologics such as abatacept adalimumab, anakinra, certolizumab, etanercept, golimumab, infliximab, ixekizumab, natalizumab, rituximab, secukinumab, tocilizumab, ustekinumab, and vedolizumab; and monoclonal antibodies such as basiliximab and daclizumab.

An IL-7Rαγc binding compound or a pharmaceutical composition thereof may be administered to a patient to treat a disease associated with the activation, proliferation, metabolism, and/or differentiation of T-cells.

An IL-7Rαγc binding compound or a pharmaceutical composition thereof may be administered to a patient to treat an organ transplant.

An IL-7Rαγc binding compound or a pharmaceutical composition thereof may be administered in conjunction with an agent known or believed to interfere with proliferation, to interfere with mitosis, to interfere with DNA replication, or to interfere with DNA repair.

An IL-7Rαγc binding compound or a pharmaceutical composition thereof may be administered to a patient to treat an immune deficiency disease.

Example of primary immune deficiency disease include autoimmune lymphoproliferative syndrome, autoimmune polyglandular syndrome type 1, BENTA disease, caspase eight deficiency state, CARD9 deficiency, chronic granulomatous disease, common variable immunodeficiency, congenital neutropenia syndromes, CTLA4 deficiency, DOCK8 deficiency, GATA2 deficiency, glycosylation disorders, hyper-immunoglobulin E syndromes, hyper-immunoglobulin M syndromes, interferon γ, interleukin 12 and interleukin 23 deficiency, leukocyte adhesion deficiency, LRBA deficiency, PI2 kinase disease, PLCG2-associated antibody deficiency and immune dysregulation, severe combined immunodeficiency, STAT3 dominant-negative disease, STAT3 gain-of-function disease, warts, hypogammaglobulinemia, infections, and myelokathexis syndrome, Wiskott-Aldrich syndrome, X-linked agammaglobulinemia, X-linked lymphoproliferative disease, and XMEN disease.

Secondary immune deficiency disease occurs when the immune system is compromised to an environmental factor such as infection, chemotherapy, severe burns, or malnutrition. Example of secondary immune deficiency diseases include newborn immunodeficiencies such as immature lymphoid organs, absent memory immunity, low maternal IgG levels, decreased neutrophil storage pool, decreased neutrophil function, and decreased natural killer cell activity; advanced age related immunodeficiencies such as decreased antigen-specific cellular immunity, T-cell oligoconality, and restricted B-cell repertoire; malnutrition related immunodeficiencies such as decreased cellular immune response and weekend mucosal barriers; diabetes mellitus related immunodeficiencies such as decreased mitogen-induced lymphoproliferation, defective phagocytosis, and decreased chemotaxis; chronic uremia related immunodeficiencies such as decreased cellular immune response, decreased generation of memory antibody responses, and decreased chemotaxis; genetic syndromes such as defective phagocytosis, defective chemotaxis, and variable defects of antigen-specific immune responses; and anti-inflammatory, immunomodulatory, and immuno-suppressive drug therapy related immune deficiencies such as lymphopenia, decreased cellular immune response and anergy, decreased proinflammatory cytokines, decreased phagocytosis, decreased chemotaxis, neutropenia, and weakened mucosal barriers; environmental conditions such as increased lymphocyte apoptosis, increased secretion of tolerogenic cytokines, cytopenia, decreased cellular immunity and anergy, and stress-induced nonspecific immune activation; and infectious diseases such as T-cell lymphopenia, decreased cellular immune response and anergy, and defective antigen-specific antibody responses.

An IL-7Rαγc binding compound or a pharmaceutical composition thereof may be administered to a patient to increase the immune response in immuno-compromised patients.

An IL-7Rαγc binding compound or a pharmaceutical composition thereof may be administered to a patient to increase the immune response in elderly patients.

An IL-7Rαγc binding compound or a pharmaceutical composition thereof may be administered to a patient to treat an infectious disease.

Examples of infectious diseases include *Acinetobacter* infections, actinomycosis, African sleeping sickness (African trypanosomiasis), AIDS (acquired immunodeficiency syndrome), amoebiasis, anaplasmosis, angiostrongyliasis, anisakiasis, anthrax, Arcanobacterium *haemolyticum* infection, Argentine hemorrhagic fever, ascariasis, aspergillosis, astrovirus infection, babesiosis, *Bacillus cereus* infection, bacterial meningitis, bacterial pneumonia, bacterial vaginosis, *Bacteroides* infection, balantidiasis, bartonellosis, *Baylisascaris* infection, Bejel, syphilis, yaws, BK virus infection, black piedra, blastocystosis, blastomycosis, Bolivian hemorrhagic fever, botulism (and Infant botulism), Brazilian hemorrhagic fever, brucellosis, bubonic plague, *Burkholderia* infection, buruli ulcer, calicivirus infection (Norovirus and Sapovirus), campylobacteriosis, candidiasis (Moniliasis; Thrush), capillariasis, carrion's disease, cat-scratch disease, cellulitis, Chagas disease (American trypanosomiasis), chancroid, chickenpox, chikungunya, *chlamydia*, *Chlamydophila pneumoniae* infection (Taiwan acute respiratory agent or TWAR), cholera, chromoblastomycosis, Chytridiomycosis, clonorchiasis, *Clostridium difficile* colitis, coccidioidomycosis, Colorado tick fever (CTF), common cold (acute viral rhinopharyngitis; Acute coryza, Coronavirus disease 2019 (COVID-19), Creutzfeldt-Jakob disease (CJD), Crimean-Congo hemorrhagic fever (CCHF), cryptococcosis, cryptosporidiosis, cutaneous larva migrans (CLM), cyclosporiasis, cysticercosis, cytomegalovirus infection, Dengue fever, desmodesmus infection, dientamoebiasis, diphtheria, diphyllobothriasis, dracunculiasis, Ebola hemorrhagic fever, echinococcosis, Ehrlichiosis, enterobiasis (pinworm infection), *Enterococcus* infection, enterovirus infection, epidemic typhus, Epstein-Barr virus infectious mononucleosis (Mono), erythema infectiosum (Fifth disease), fxanthem subitum (Sixth disease), fasciolosis, fasciolopsiasis, fatal familial insomnia (FFI), filariasis, food poisoning by *Clostridium perfringens*, free-living amebic infection, *Fusobacterium* infection, gas gangrene (Clostridial myonecrosis), geotrichosis, Gerstmann-Straussler-Scheinker syndrome (GSS), giardiasis, glanders, gnathostomiasis, gonorrhea, granuloma inguinale (Donovanosis), Group A streptococcal infection, Group B streptococcal infection, *Haemophilus influenzae* infection, hand, foot and mouth disease (HFMD), Hantavirus Pulmonary Syndrome (HPS), Heartland virus disease, *Helicobacter pylori* infection, hemolytic-uremic syndrome (HUS), hemorrhagic fever with renal syndrome (HFRS), Hendra virus infection, Hepatitis A, Hepatitis B, Hepatitis C, Hepatitis D, Hepatitis E, Herpes simplex, histoplasmosis, hookworm infection, human bocavirus infection, human ewingii ehrlichiosis, human granulocytic anaplasmosis (HGA), human metapneumovirus infection, human monocytic ehrlichiosis, human papillomavirus (HPV) infection, human parainfluenza virus infection, hymenolepiasis, influenza (flu), isosporiasis, Kawasaki disease, keratitis, Kingella kingae infection, Kuru, Lassa fever, Legionellosis (Legionnaires' disease), leishmaniasis, leprosy, leptospirosis, listeriosis, Lyme disease (Lyme borreliosis), lymphatic filariasis (elephantiasis), lymphocytic choriomeningitis, malaria, Marburg hemorrhagic fever (MHF), measles, melioidosis (Whitmore's disease), meningitis, meningococcal disease, metagonimiasis, microsporidiosis, Middle East respiratory syndrome (MERS), molluscum contagiosum (MC), monkeypox, mumps, murine typhus (Endemic typhus), mycetoma, *Mycoplasma genitalium* infection, mycoplasma pneumonia, myiasis, neonatal conjunctivitis (Ophthalmia neonatorum), Nipah virus infection, nocardiosis, Norovirus (children and babies), onchocerciasis (River blindness), opisthorchiasis, paracoccidioidomycosis (South American blastomycosis), paragonimiasis, pasteurellosis, pediculosis capitis (Head lice), pediculosis corporis (Body lice), pediculosis pubis (pubic lice, crab lice), pelvic inflammatory disease (PID), pertussis (whooping cough), plague, pneumococcal infection, *pneumocystis* pneumonia (PCP), pneumonia, poliomyelitis, Pontiac fever, *Prevotella* infection, primary amoebic meningoencephalitis (PAM), progressive multifocal leukoencephalopathy, psittacosis, Q fever, rabies, relapsing fever, respiratory syncytial virus infection, rhinosporidiosis, rhinovirus infection, rickettsial infection, rickettsialpox, Rift Valley fever (RVF), Rocky Mountain spotted fever (RMSF), rotavirus infection, rubella, *salmonellosis*, SARS (severe acute respiratory syndrome), scabies, scarlet fever, schistosomiasis, sepsis, shigellosis (bacillary dysentery), shingles (Herpes zoster), smallpox (variola), sporotrichosis, staphylococcal food poisoning, staphylococcal infection, strongyloidiasis, subacute sclerosing panencephalitis, taeniasis, tetanus (lockjaw), tinea barbae (barber's itch), tinea capitis (ringworm of the scalp), tinea corporis (ringworm of the body), tinea cruris (Jock itch), tinea manum (ringworm of the hand), tinea nigra, tinea pedis (athlete's foot), tinea unguium (onychomycosis), tinea *versicolor* (*Pityriasis versicolor*), toxocariasis (ocular larva migrans (OLM), toxocariasis (visceral larva migrans (VLM), toxoplasmosis, trachoma, trichinosis, trichomoniasis, trichuriasis (whipworm infection), tuberculosis, tularemia, typhoid fever, typhus fever, *Ureaplasma urealyticum* infection, valley fever, Venezuelan equine encephalitis, Venezuelan hemorrhagic fever, *vibrio parahaemolyticus* enteritis, *vibrio vulnificus* infection, viral pneumonia, West Nile fever, white piedra (tinea blanca), yellow fever, *Yersinia pseudotuberculosis* infection, yersiniosis, zeaspora, Zika fever, and zygomycosis.

An IL-7Rαγc binding compound provided by the present disclosure can be used, either alone or in combination, to treat diseases including acute myeloid leukemia, B-cell lymphoma, chronic myelogenous leukemia, depression, gingival recession, hepatitis C, HIV infections, human papillomavirus, idiopathic CD4 lymphopenia, immunodeficiency secondary to organ transplantation, lipodystrophy, Kaposi sarcoma lymphoma, lymphopenia, mantle cell lymphoma, multiple sclerosis, myelodysplastic syndrome, non-Hodgkin lymphoma, recurrent adult diffuse large cell lymphoma, recurrent follicular lymphoma, rheumatoid arthritis, sepsis, and Type 2 diabetes.

An IL-7Rαγc binding compound provided by the present disclosure can be used to treat cancers such as metastatic breast cancer, breast cancer, colon cancer, bladder cancer, metastatic prostate cancer, stage IV prostate cancer, castration-resistant prostate carcinoma, neuroblastoma, melanoma, kidney cancer, myeloproliferative neoplasm, sarcoma, and neurodermal tumors.

An IL-7Rαγc binding compound provided by the present disclosure can be used in combination with temozolomide to great glioblastoma, with atezolizumab to treat skin cancers such as MCC, C5CC and melanoma, with pembrolizumab to treat triple negative breast cancer, and in combination with CAR-T therapy to treat pediatric acute lymphoblastic leukemia.

Pharmaceutical compositions comprising an IL-7Rαγc binding compound be administered concurrently with the administration of another therapeutic agent, which may be part of the same pharmaceutical composition as, or in a different pharmaceutical composition than that comprising an IL-7Rαγc binding compound. An IL-7Rαγc binding compound may be administered prior or subsequent to administration of another therapeutic agent. In combination therapy, the combination therapy may comprise alternating between administering an IL-7Rαγc binding compound and a composition comprising another therapeutic agent, e.g., to minimize adverse drug effects associated with a particular drug. When an IL-7Rαγc binding compound is administered concurrently with another therapeutic agent that potentially may produce an adverse drug effect including, for example, toxicity, the other therapeutic agent may be administered at a dose that falls below the threshold at which the adverse drug reaction is elicited.

Pharmaceutical compositions comprising an IL-7Rαγc binding compound may be administered with one or more substances to enhance, modulate and/or control release, bioavailability, therapeutic efficacy, therapeutic potency, stability, and the like of a compound of an IL-7Rαγc binding compound. For example, to enhance the therapeutic efficacy of an IL-7Rαγc binding compound, metabolite thereof, or a pharmaceutical composition of any of the foregoing may be co-administered with one or more active agents to increase the absorption or diffusion of the IL-7Rαγc binding compound from the gastrointestinal tract to the systemic circulation, or to inhibit degradation of the IL-7Rαγc binding compound in the blood of a subject. A pharmaceutical composition comprising an IL-7Rαγc binding compound may be co-administered with an active agent having pharmacological effects that enhance the therapeutic efficacy of the IL-7Rαγc binding compound.

An IL-7Rαγc binding compound, or a pharmaceutical composition comprising any of the foregoing may be administered in conjunction with an agent known or believed to be effective in treating an inflammatory disease or an autoimmune disease in a patient.

An IL-7Rαγc binding compound, or a pharmaceutical composition comprising any of the foregoing may be administered in conjunction with an agent known or believed to interfere with proliferation. An IL-7Rαγc binding compound, or a pharmaceutical composition comprising any of the foregoing may be administered in conjunction with an agent known or believed to interfere with mitosis. An IL-7Rαγc binding compound, or a pharmaceutical composition comprising any of the foregoing may be administered in conjunction with an agent known or believed to interfere with DNA replication. An IL-7Rαγc binding compound, or a pharmaceutical composition comprising an IL-7Rαγc binding compound may be administered in conjunction with an agent known or believed to interfere with DNA repair.

An IL-7Rαγc binding compound or a pharmaceutical composition thereof may be administered to a patient together with another compound for treating an inflammatory disease or an autoimmune disease in the patient. The at least one other therapeutic agent may be a different IL-7Rαγc binding compound provided by the present disclosure. An IL-7Rαγc binding compound and the at least one other therapeutic agent may act additively or synergistically. The at least one additional therapeutic agent may be included in the same pharmaceutical composition or vehicle comprising the IL-7Rαγc binding compound or may be in a separate pharmaceutical composition or vehicle. Accordingly, methods provided by the present disclosure further include, in addition to administering an IL-7Rαγc binding compound, administering one or more therapeutic agents effective for treating an inflammatory disease or an autoimmune disease or a different disease, disorder or condition than an inflammatory disease or an autoimmune disease. Methods provided by the present disclosure include administering IL-7Rαγc binding compound and one or more other therapeutic agents provided that the combined administration does not inhibit the therapeutic efficacy of the IL-7Rαγc binding compound and/or does not produce adverse combination effects.

Compounds provided by the present disclosure can be useful in vitro as tools for understanding the biological role of IL-7, including the evaluation of the many factors thought to influence, and be influenced by, the production of IL-7 and the receptor binding process. The present compounds are also useful in the development of other compounds that bind to and activate IL-7R, because the present compounds provide useful information concerning the relationship between structure and activity that should facilitate such development.

The compounds are also useful as competitive binders in assays to screen for new IL-7 receptor agonists and antagonists. In such assays, IL-7Rαγc binding compounds can be used without modification or can be modified in a variety of ways; for example, by labeling, such as covalently or non-covalently joining a moiety which directly or indirectly provides a detectable signal. In any of these assays, the materials thereto can be labeled either directly or indirectly. Possibilities for direct labeling include label groups such as: radiolabels such as $^{125}$I, enzymes such as peroxidase and alkaline phosphatase, and fluorescent labels capable of monitoring the change in fluorescence intensity, wavelength shift, or fluorescence polarization. Possibilities for indirect labeling include biotinylation of one constituent followed by binding to avidin coupled to one of the above label groups. The compounds may also include spacers or linkers in cases where the compounds are to be attached to a solid support.

Based on their ability to bind to the IL-7R, IL-7Rαγc binding compounds provided by the present disclosure can be used as reagents for detecting IL-7R, for example, on living cells, fixed cells, in biological fluids, in tissue homogenates, in purified, and natural biological materials. For example, by labeling such peptides, one can identify cells expressing the IL-7Rα and Rγc subunits. In addition, based on their ability to bind to IL-7R, the IL-7Rαγc binding compounds of the present disclosure can be used, for example, in in situ staining, FACS (fluorescence-activated cell sorting), Western Blotting, and ELISA. In addition, based on their ability to bind to IL-7R, IL-7Rαγc binding compounds provided by the present disclosure can be used in receptor purification, or in purifying cells expressing IL-7R on the cell surface (or inside permeabilized cells).

IL-7Rαγc binding compounds provided by the present disclosure can also be utilized as commercial reagents for various medical research and diagnostic uses. Such uses include, for example, (1) use as a calibration standard for quantitating the activities of candidate IL-7 agonists in a variety of functional assays; (2) use to maintain the proliferation and growth of IL-7-dependent cell lines; (3) use in structural analysis of IL-7R through co-crystallization; (4) use to investigate the mechanism of IL-7 signal transduction/receptor activation; and (5) other research and diagnostic applications wherein the IL-7 receptor is implicated.

IL-7Rαγc binding compounds include diagnostic reagents. As a diagnostic agent, a compound comprising an IL-7Rαγc ligand can be used to detect and/or to measure cells expressing the IL-7R subunit. The compounds can be used to determine the level of IL-7R expression of a cell, or population of cells, or of a tissue. The compounds can be used to assess the binding affinity to IL-7R in a cell or population of cells. The compounds may be used to determine the particular type of cell, for example, based on IL-7R expression levels.

The compounds can be useful for in vitro and in vivo diagnostics.

A diagnostic IL-7Rαγc binding compound can comprise a detectable marker. The detectable marker can be cleavable or non-cleavable.

A detectable marker can comprise, for example, a radiolabel, a fluorescent label, an enzymatic label.

A diagnostic IL-7Rαγc binding compound can be used to measure cells expressing the IL-7Rα subunit and/or the level of expression of cells expressing the IL-7Rα subunit in a biological sample such as a sample of blood of a patient. Measurements can be made, for example, using flow cytometry. The number of cells expressing the IL-7Rα subunit and/or the expression level of the IL-7Rα subunit, when correlated with a disease in a patient or a pharmacologically significant parameter of the disease in a patient can be used to inform treatment of the disease. For example, if a level of expression of the IL-7Rα subunit is above or below a therapeutically meaningful threshold for a particular disease, a compound comprising an IL-7Rα ligand provided by the present disclosure can be administered to the patient to treat the disease.

IL-7Rαγc binding compounds can be attached to a solid support. Based on the ability of the compounds to bind to IL-7R, the compounds can be used as reagents for detecting IL-7R, for example, on living cells, fixed cells, in biological fluids, in tissue homogenates, in purified, and natural in biological materials. In addition, based on their ability to bind to the IL-7R subunit, the peptides of the present invention can be used, for example, in in situ staining, FACS (fluorescence-activated cell sorting), Western Blotting, and ELISA. In addition, compounds provided by the present disclosure can be used in receptor purification, or to purify cells expressing IL-7R on the cell surface.

Aspects of the present invention include nucleic acids encoding for the IL-7Rα ligands, Rγc ligands, IL-7Rαγc ligands, tandem IL-7Rαγc ligands and IL-7Rαγc ligand constructs provided by the present disclosure.

Nucleic acids/isolated polynucleotides encoding the IL-7Rα ligands, Rγc ligands, IL-7Rαγc ligands, tandem IL-7Rαγc ligands, and IL-7Rαγc ligand constructs provided by the present disclosure can be incorporated into expression vectors depending in part on the host cells used to produce the IL-7Rα ligands, the Rγc ligands, IL-7Rαγc ligands, tandem IL-7Rαγc ligands, and IL-7Rαγc ligand constructs. Generally, the nucleic acids can be operably linked to any number of regulatory elements such as, for example, promoters, origin of replication, selectable markers, ribosomal binding sites, and/or inducers. The expression vectors can be extra-chromosomal or integrating vectors.

The nucleic acids and/or expression vectors can be transformed into any number of different types of host cells including mammalian, bacterial, yeast, insect and/or fungal cells, with mammalian cells such as CHO cells.

A nucleic acid encoding an IL-7Rαγc ligand can comprise a first nucleic acid sequence encoding an IL-7Rα ligand; a second nucleic acid sequence encoding a peptidyl ligand linker; and a third nucleic acid sequence encoding an Rγc ligand.

A nucleic acid encoding an IL-7Rαγc ligand fusion protein can comprise a first nucleic acid sequence encoding the IL-7Rαγc ligand provided by the present disclosure; and a second nucleic acid sequence encoding a fusion partner. A nucleic acid encoding an IL-7Rαγc ligand fusion protein can comprise a nucleic acid encoding an IL-7Rαγc ligand and the fusion partner. A nucleic acid encoding an IL-7Rαγc ligand fusion protein can further comprise a nucleic acid segment encoding a construct linker and a nucleic acid encoding an IL-7Rαγc ligand fusion protein can comprise a nucleic acid encoding an IL-7Rαγc ligand, the fusion partner, and the construct linker.

The fusion partner can comprise, for example, HSA, an Fc-fragment, an IgG, an antibody directed to a cell-specific antigen, and an antibody directed to a cell-specific receptor.

A nucleic acid encoding an IL-7Rαγc ligand fusion protein can further comprise a nucleic acid encoding a peptidyl linker, where the peptidyl linker is configured to bind the IL-7Rαγc ligand to the fusion partner.

A nucleic acid provided by the present disclosure can encode a fusion protein comprising an IL-7Rαγc ligand, and a linker binding the C-terminus of the IL-7Rαγc ligand to HSA.

A nucleic acid provided by the present disclosure can encode a fusion protein comprising a dimeric Fc-Fragment of IgG1, IgG2, or IgG4, an IL-7Rαγc ligand, and a linker binding the N-terminus of an IL-7Rαγc ligand to the C-terminus of one CH3 domain of the dimeric Fc-fragment.

A nucleic acid provided by the present disclosure can encode a fusion protein comprising a dimeric Fc-Fragment of IgG1, IgG2, or IgG4, two IL-7Rαγc ligands, and a linker binding the N-terminus of each of the two IL-7Rαγc ligands to the C-terminus of each CH3 domain of the dimeric Fc-fragment.

A nucleic acid provided by the present disclosure can encode a fusion protein comprising a heavy chain of an immunoglobulin molecule such as IgG1, IgG2, or IgG4, an IL-7Rαγc ligand, and an Fc linker bonding the N-terminus of the IL-7Rαγc ligand to the C-terminus of the Fc region.

A nucleic acid provided by the present disclosure can comprise a nucleic acid encoding for an IL-7Rαγc binding compound provided by the present disclosure and an RNA and/or DNA vaccine.

A nucleic acid provided by the present disclosure can comprise a nucleic acid encoding for an IL-7Rαγc vaccine construct. The vaccine can comprise, for example, a cancer vaccine or a viral vaccine.

A nucleic acid provided by the present disclosure can comprise a nucleic acid encoding for an IL-7Rαγc construct comprising a viral surface antigen.

A nucleic acid provided by the present disclosure can comprise a nucleic acid encoding for an IL-7Rαγc construct comprising a virus-like particle.

A nucleic acid provided by the present disclosure can encode for an IL-7Rα ligand comprising an amino acid sequence of any one of SEQ ID NOS: 389-410, 420-556 and 9434-9437, a truncated amino acid sequence of any one of SEQ ID NOS: 389-410, 420-556 and 9434-9437, a substituted amino acid sequence of any one of SEQ ID NOS: 389-410, 420-556 and 9434-9437, or can encode for an amino acid sequence comprising an amino acid sequence having greater than 60%, greater than 70%, greater than 80%, greater than 85%, greater than 90%, or greater than 95% sequence similarity to any one of: SEQ ID NOS: 389-410, 420-556 and 9434-9437.

A nucleic acid provided by the present disclosure can encode for an IL-7Rα ligand comprising an amino acid sequence of any one of SEQ ID NOS: 407 and 454-474, or can encode for an amino acid sequence comprising an amino acid sequence having greater than 60%, greater than 70%, greater than 80%, greater than 85%, greater than 90%, or greater than 95% sequence similarity to any one of SEQ ID NOS: 407 and 454-474.

A nucleic acid provided by the present disclosure can encode for an Rγc ligand comprising an amino acid sequence of any one of SEQ ID NOS: 944-1031 and 9438-9443, a truncated amino acid sequence of any one of SEQ ID NOS: 944-1031 and 9438-9443, a substituted amino acid sequence of any one of SEQ ID NOS: 944-1031 and 9438-9443, or can encode for an amino acid sequence comprising an amino acid sequence having greater than 60%, greater than 70%, greater than 80%, greater than 85%, greater than 90%, or greater than 95% sequence similarity to any one of SEQ ID NOS: 944-1031 and 9438-9443.

A nucleic acid provided by the present disclosure can encode for an Rγc ligand comprising an amino acid sequence of any one of SEQ ID NOS: 965 and 1029-1031, or can encode for an amino acid sequence comprising an amino acid sequence having greater than 60%, greater than 70%, greater than 80%, greater than 85%, greater than 90%, or greater than 95% sequence similarity to any one of SEQ ID NOS: 965 and 1029-1031.

A nucleic acid provided by the present disclosure can encode for an IL-7Rαγc ligand comprising an IL-7Rα ligand comprising an amino acid sequence of any one of SEQ ID NOS: 407 and 454-474, or can encode for an amino acid sequence comprising an amino acid sequence having greater than 60%, greater than 70%, greater than 80%, greater than 85%, greater than 90%, or greater than 95% sequence similarity to any one of SEQ ID NOS: 407 and 454-474; and an IL-7Rgc ligand comprising an amino acid sequence of any one of SEQ ID NOS: 965 and 1029-1031, or can encode for an amino acid sequence comprising an amino acid sequence having greater than 60%, greater than 70%, greater than 80%, greater than 85%, greater than 90%, or greater than 95% sequence similarity to any one of SEQ ID NOS: 965 and 1029-1031.

A nucleic acid provided by the present disclosure can encode for an IL-7Rαγc ligand comprising an amino acid sequence of any one of SEQ ID NOS: 2012-2023 and 2058-2120, or can encode for an amino acid sequence comprising an amino acid sequence having greater than 60%, greater than 70%, greater than 80%, greater than 85%, greater than 90%, or greater than 95% sequence similarity to any one of SEQ ID NOS: 2012-2023 and 2058-2120.

A nucleic acid provided by the present disclosure can encode for an IL-7Rαγc ligand fusion protein comprising an amino acid sequence of any one of SEQ ID NOS: 2012, 2084-2087, and 2091-2120 or can encode for an amino acid sequence comprising an amino acid sequence having greater than 60%, greater than 70%, greater than 80%, greater than 85%, greater than 90%, or greater than 95% sequence similarity to any one of SEQ ID NOS: 2012, 2084-2087, and 2091-2120.

A nucleic acid provided by the present disclosure can encode for an IL-7Rαγc ligand construct comprising an IL-7Rα ligand comprising an amino acid sequence of any one of SEQ ID NO: SEQ ID NOS: 407 and 454-474 or an amino acid sequence comprising an amino acid sequence having greater than 60%, greater than 70%, greater than 80%, greater than 85%, greater than 90%, or greater than 95% sequence similarity to SEQ ID NOS: 407 and 454-474; and an Rγc ligand comprising an amino acid sequence of SEQ ID NOS: 965 and 1029-1031 or an amino acid sequence comprising an amino acid sequence having greater than 60%, greater than 70%, greater than 80%, greater than 85%, greater than 90%, or greater than 95% sequence similarity to any one of SEQ ID NOS: 965 and 1029-1031.

A nucleic acid provided by the present disclosure can encode for a tandem IL-7Rαγc ligand comprising two or more IL-7Rαγc ligands provided by the present disclosure.

Aspects of the invention include expression vectors comprising a nucleic acid encoding an IL-7Rα ligand, an Rγc ligand, an IL-7Rαγc ligand, a tandem IL-7Rαγc ligand, or an IL-7Rαγc ligand construct provided by the present disclosure.

Aspects of the invention further include a host cell comprising an expression vector comprising a nucleic acid encoding an IL-7Rα ligand, an Rγc ligand, an IL-7Rαγc ligand, a tandem IL-7Rαγc ligand, or an IL-7Rαγc ligand construct provided by the present disclosure.

Methods provided by the present disclosure include methods of making an IL-7Rα ligand, an Rγc ligand, an IL-7Rαγc ligand, a tandem IL-7Rαγc ligand, or an IL-7Rαγc ligand construct provided by the present disclosure, comprising culturing a host cell, wherein the host cell comprises an expression vector comprising a nucleic acid encoding an IL-7Rα ligand, an Rγc ligand, an IL-7Rαγc ligand, a tandem IL-7Rαγc ligand, or an IL-7Rαγc ligand construct provided by the present disclosure, under conditions where the IL-7Rα ligand, Rγc ligand, IL-7Rαγc ligand, tandem IL-7Rαγc ligand, or IL-7Rαγc ligand construct is expressed, and recovering the expressed IL-7Rα ligand, Rγc ligand, IL-7Rαγc ligand, tandem IL-7Rαγc ligand, or IL-7Rαγc ligand construct.

ASPECTS OF THE INVENTION

The invention is further defined by the following aspects.
Aspect 1. An IL-7Rαγc ligand comprising:
(a) an IL-7Rα ligand, wherein the IL-7Rα ligand comprises an amino acid sequence of Formula (1) (SEQ ID NO: 389), Formula (1a) (SEQ ID NO: 390), Formula (1b) (SEQ ID NO: 391), or Formula (1c) (SEQ ID NO: 392);

(1)
$-X^{201}-X^{202}-X^{203}-X^{204}-X^{205}-X^{206}-X^{207}-X^{208}-X^{209}-$
$X^{210}-X^{211}-X^{212}-X^{213}-X^{214}-X^{215}-X^{216}-$ (1a)
$-X^{202}-X^{203}-X^{204}-X^{205}-X^{206}-X^{207}-X^{208}-X^{209}-$
$X^{210}-X^{211}-X^{212}-X^{213}-X^{214}-X^{215}-$ (1b)
$-X^{203}-X^{204}-X^{205}-X^{206}-X^{207}-X^{208}-X^{209}-X^{210}-$
$X^{211}-X^{212}-X^{213}-X^{214}-$ (1c)
$-X^{204}-X^{205}-X^{206}-X^{207}-X^{208}-X^{209}-X^{210}-X^{211}-$
$X^{212}-X^{213}-$ wherein,
$X^{201}$ is selected from H, I, Q, and V;
$X^{202}$ is selected from C, P, and R;
$X^{203}$ is selected from I, K, L, S, V, and W;
$X^{204}$ is selected from C and H;
$X^{205}$ is selected from A, I, L, M, T, and W;
$X^{206}$ is selected from D, L, and W;
$X^{207}$ is selected from D, I, L, and Q;
$X^{208}$ is selected from D, E, and P;
$X^{209}$ is selected from G, S, and T;
$X^{210}$ is selected from A, G, L, and S;
$X^{211}$ is selected from F, I, L, and M;
$X^{212}$ is selected from G, H, L, N, Q, and S;
$X^{213}$ is C;
$X^{214}$ is selected from A, E, I, L, S, T, and V;
$X^{215}$ is selected from F, R, W, and Y; and
$X^{216}$ is selected from E, L, Q, and W; and (b) an Rγc ligand, wherein the Rγc ligand comprises an amino acid sequence of Formula (3) (SEQ ID NO: 944), Formula (3a) (SEQ ID NO: 945), Formula (3b) (SEQ ID NO: 946), Formula (3c) (SEQ ID NO: 947), Formula (3d) (SEQ ID NO: 948), or Formula (3e) (SEQ ID NO: 949):;

(3)
$-X^{171}-X^{172}-X^{173}-X^{174}-X^{175}-C-X^{176}-X^{177}-X^{178}-X^{179}-X^{180}-X^{181}-X^{182}-X^{183}-C-X^{184}-X^{185}-X^{186}-X^{187}-X^{188}-$ (3a)
$-X^{172}-X^{173}-X^{174}-X^{175}-C-X^{176}-X^{177}-X^{178}-X^{179}-X^{180}-X^{181}-X^{182}-X^{183}-C-X^{184}-X^{185}-X^{186}-X^{187}-$ (3b)
$-X^{173}-X^{174}-X^{175}-C-X^{176}-X^{177}-X^{178}-X^{179}-X^{180}-X^{181}-X^{182}-X^{183}-C-X^{184}-X^{185}-X^{186}-$ (3c)
$-X^{174}-X^{175}-C-X^{176}-X^{177}-X^{178}-X^{179}-X^{180}-X^{181}-X^{182}-X^{183}-C-X^{184}-X^{185}-$ (3d)
$-X^{175}-C-X^{176}-X^{177}-X^{178}-X^{179}-X^{180}-X^{181}-X^{182}-X^{183}-C-X^{184}-$ (3e)
$-C-X^{176}-X^{177}-X^{178}-X^{179}-X^{180}-X^{181}-X^{182}-X^{183}-C-$ wherein,
$X^{171}$ is selected from H, K, and R;
$X^{172}$ is selected from S, T, and Y;
$X^{173}$ is selected from D, E, F, I, L, M, V, W, and Y;
$X^{174}$ is selected from F, I, L, M, V, W, and Y;
$X^{175}$ is selected from D, E, F, I, L, M, V, W, and Y;
$X^{176}$ is selected from D, E, H, N, Q, S, T, and Y;
$X^{177}$ is selected from D and E;
$X^{178}$ is selected from F, H, I, L, M, V, W, and Y;
$X^{179}$ is selected from D, E, H, N, Q, S, T, and Y;
$X^{180}$ is G;
$X^{181}$ is V;
$X^{182}$ is E;
$X^{183}$ is L;
$X^{184}$ is selected from W;
$X^{185}$ is selected from F, I, L, M, V, W, Y, H, N, Q, S, and T;
$X^{186}$ is E;
$X^{187}$ is selected from an amino acid; and
$X^{188}$ is selected from D and E.

Aspect 2. The IL-7Rαγc ligand of aspect 1, wherein in an IL-7Rα ligand of Formula (1)-(1c):
$X^{201}$ is selected from I, Q, and V;
$X^{202}$ is selected from C and P;
$X^{203}$ is W;
$X^{204}$ is selected from C and H;
$X^{205}$ is selected from T and W;
$X^{206}$ is selected from D and L;
$X^{207}$ is selected from D and L;
$X^{208}$ is selected from E and P;
$X^{209}$ is selected from G and S;
$X^{210}$ is selected from L and S;
$X^{211}$ is L;
$X^{212}$ is selected from Q and S;
$X^{213}$ is C;
$X^{214}$ is selected from A and V;
$X^{215}$ is W; and
$X^{216}$ is L.

Aspect 3. The IL-7Rαγc ligand of aspect 1, wherein in an IL-7Rα ligand of Formula (1)-(1c):
$X^{201}$ is I;
$X^{202}$ is selected from C and P;
$X^{203}$ is W;
$X^{204}$ is selected from C and H;
$X^{205}$ is selected from T and W;
$X^{206}$ is selected from D and L;
$X^{207}$ is D;
$X^{208}$ is P;
$X^{209}$ is G;
$X^{210}$ is selected from L and S;
$X^{211}$ is L;
$X^{212}$ is Q;
$X^{213}$ is C;
$X^{214}$ is selected from A and V;
$X^{215}$ is W; and
$X^{216}$ is L.

Aspect 4. The IL-7Rαγc ligand of aspect 1, wherein in an IL-7Rα ligand of Formula (1)-(1c):
$X^{201}$ is Q;
$X^{202}$ is C;
$X^{203}$ is selected from I, L, K, and V;
$X^{204}$ is H;
$X^{205}$ is W;
$X^{206}$ is D;
$X^{207}$ is selected from I and L;
$X^{208}$ is E;
$X^{209}$ is selected from S and T;
$X^{210}$ is L;
$X^{211}$ is L;
$X^{212}$ is selected from G, L, N, and S;
$X^{213}$ is C;
$X^{214}$ is selected from I, L, and V;
$X^{215}$ is R; and
$X^{216}$ is E.

Aspect 5. The IL-7Rαγc ligand of aspect 1, wherein in an IL-7Rα ligand of Formula (1)-(1c):
$X^{201}$ is selected from I and V;
$X^{202}$ is P;
$X^{203}$ is W;
$X^{204}$ is C;
$X^{205}$ is T;
$X^{206}$ is L;
$X^{207}$ is D;
$X^{201}$ is P;
$X^{209}$ is G;
$X^{210}$ is selected from L and S;
$X^{211}$ is L;
$X^{212}$ is Q;
$X^{213}$ is C;
$X^{214}$ is A;
$X^{215}$ is selected from W; and
$X^{216}$ is L.

Aspect 6. The IL-7Rαγc ligand of aspect 1, wherein the IL-7Rα ligand comprises a truncated amino acid sequence of Formula (1), Formula (1a), Formula (1b), or Formula (1c).

Aspect 7. The IL-7Rαγc ligand of any one of aspects 1 to 8, wherein from 1 to 5 of the amino acids of the IL-7Rα ligand are independently substituted with another amino acid.

Aspect 8. The IL-7Rαγc ligand of any one of aspects 1 to 7, wherein the amino acid sequence of the IL-7Rα ligand independently comprises from 1 to 4 glycines (G) (SEQ ID NO: 2045) on the N-terminus, on the C-terminus, or on both the N- and C-termini.

Aspect 9. The IL-7Rαγc ligand of any one of aspects 1 to 8, wherein the IL-7Rα ligand comprises an amino acid sequence having greater than 60% sequence similarity to the amino acid sequence.

Aspect 10. The IL-7Rαγc ligand of any one of aspects 1 to 9, wherein the IL-7Rα ligand comprises an amino acid sequence of any one of SEQ ID NO: 389-410, 420-556 and 9434-9437.

Aspect 11. The IL-7Rαγc ligand of aspect 10, wherein the IL-7Rα ligand comprises a truncated amino acid sequence of any one of SEQ ID NO: 389-410, 420-556 and 9434-9437.

Aspect 12. The IL-7Rαγc ligand of aspect 10, wherein the IL-7Rα ligand comprises an amino acid sequence of any one of SEQ ID NOS: 407 and 454-474.

Aspect 13. The IL-7Rαγc ligand of any one of aspects 10 to 12, wherein from 1 to 5 of the amino acids of the IL-7Rα ligand are independently substituted with another amino acid.

Aspect 14. The IL-7Rαγc ligand of any one of aspects 10 to 13, wherein the amino acid sequence comprises from 1 to 4 glycines (G) (SEQ ID NO: 2045) on the N-terminus, on the C-terminus, or on both the N- and C-termini.

Aspect 15. The IL-7Rαγc ligand of any one of aspects 10 to 14, wherein the IL-7Rα ligand comprises an amino acid sequence having greater than 60% sequence similarity any one of SEQ ID NOS: 389-410, 420-556 and 9434-9437.

Aspect 16. The IL-7Rαγc ligand of aspect 1, wherein the IL-7Rα ligand comprises an amino acid sequence of SEQ ID NOS: 407 and 454-474.

Aspect 17. The IL-7Rαγc ligand of aspect 16, wherein the IL-7Rα ligand comprises a truncated amino acid sequence of SEQ ID NOS: 407 and 454-474.

Aspect 18. The IL-7Rαγc ligand of any one of aspects 16 to 17, wherein from 1 to 5 of the amino acids of the IL-7Rα ligand are independently substituted with another amino acid.

Aspect 19. The IL-7Rαγc ligand of any one of aspects 16 to 18, wherein the amino acid sequence comprises from 1 to 4 glycines (G) (SEQ ID NO: 2045) on the N-terminus, on the C-terminus, or on both the N- and C-termini.

Aspect 20. The IL-7Rαγc ligand of any one of aspects 16 to 19, wherein the IL-7Rα ligand comprises an amino acid sequence having greater than 60% sequence similarity to SEQ ID NOS: 407 and 454-474.

Aspect 21. The IL-7Rαγc ligand of any one of aspects 1 to 20, wherein in an Rγc ligand of Formula (3)-(3e):
$X^{171}$ is selected from H, K, and R;
$X^{172}$ is selected from S, T, and Y;
$X^{173}$ is selected from D and E;
$X^{174}$ is V;
$X^{175}$ is selected from D and E;
$X^{176}$ is selected from E and Q;
$X^{177}$ is selected from D and E;
$X^{178}$ is selected from F, H, W, and Y;
$X^{179}$ is selected from D, E, and Q;
$X^{180}$ is G;
$X^{181}$ is V;
$X^{182}$ is E;
$X^{183}$ is L;
$X^{184}$ is W;
$X^{185}$ is selected from F, I, L, M, V, W, Y, H, N, Q, S, and T;
$X^{186}$ is E;
$X^{187}$ is selected from an amino acid; and
$X^{188}$ is selected from D and E.

Aspect 22. The IL-7Rαγc ligand of any one of aspects 1 to 20, wherein in an Rγc ligand of Formula (3)-(3e):
$X^{171}$ is selected from H, K, and R;
$X^{172}$ is selected from S, T, and Y;
$X^{173}$ is selected from F, I, L, M, V, W, and Y;
$X^{174}$ is V;
$X^{175}$ is selected from F, I, L, M, V, W, and Y;
$X^{176}$ is selected from E and Q;
$X^{177}$ is selected from D and E;
$X^{178}$ is selected from F, H, W, and Y;
$X^{179}$ is selected from D, E, and Q;
$X^{180}$ is G;
$X^{181}$ is V;
$X^{182}$ is E;
$X^{183}$ is L;
$X^{184}$ is W;
$X^{185}$ is selected from F, I, L, M, V, W, Y, H, N, Q, S, and T;
$X^{186}$ is E;
$X^{187}$ is selected from an amino acid; and
$X^{188}$ is selected from D and E.

Aspect 23. The IL-7Rαγc ligand of any one of aspects 1 to 20, wherein in an Rγc ligand of Formula (3)-(3e):
$X^{171}$ is selected from H, K, and R;
$X^{172}$ is selected from S, T, and Y;
$X^{173}$ is selected from D, E, F, I, L, M, V, W, and Y;
$X^{174}$ is V;
$X^{175}$ is selected from D, E, F, I, L, M, V, W, and Y;
$X^{176}$ is selected from D, E, H, N, Q, S, T, and Y;
$X^{176}$ is selected from E and Q;
$X^{177}$ is selected from D and E;
$X^{178}$ is W;
$X^{179}$ is selected from D, E, and Q;
$X^{180}$ is G;
$X^{181}$ is V;
$X^{182}$ is E;
$X^{183}$ is L;
$X^{184}$ is W;
$X^{185}$ is selected from F, I, L, M, V, W, Y, H, N, Q, S, and T;
$X^{186}$ is E;
$X^{187}$ is selected from an amino acid; and
$X^{188}$ is selected from D and E.

Aspect 24. The IL-7Rαγc ligand of any one of aspects 1 to 23, wherein from 1 to 5 of the amino acids of the Rγc ligand are independently substituted with another amino acid.

Aspect 25. The IL-7Rαγc ligand of any one of aspects 1 to 24, wherein the amino acid sequence of the Rγc ligand independently comprises from 1 to 4 glycines (G) (SEQ ID NO: 2045) on the N-terminus, on the C-terminus, or on both the N- and C-termini.

Aspect 26. The IL-7Rαγc ligand of any one of aspects 1 to 25, wherein the Rγc ligand comprises an amino acid sequence having greater than 60% sequence similarity to the amino acid sequence.

Aspect 27. The IL-7Rαγc ligand of any one of aspects 1 to 20, wherein the Rγc ligand comprises an amino acid sequence of any one of SEQ ID NOS: 944-1031 and 9438-9443.

Aspect 28. The IL-7Rαγc ligand of any one of aspects 1 to 20, wherein the Rγc ligand comprises a truncated amino acid sequence of any one of SEQ ID NOS: 944-1031 and 9438-9443.

Aspect 29. The IL-7Rαγc ligand of any one of aspects 27 to 28, wherein from 1 to 5 of the amino acids of the IL-7Rα ligand are independently substituted with another amino acid.

Aspect 30. The IL-7Rαγc ligand of any one of aspects 27 to 29, wherein the amino acid sequence of the IL-7Rα ligand independently comprises from 1 to 4 glycines (G) (SEQ ID NO: 2045) on the N-terminus, on the C-terminus, or on both the N- and C-termini.

Aspect 31. The IL-7Rαγc ligand of any one of aspects 27 to 30, wherein the Rγc ligand comprises an amino acid sequence having greater than 60% sequence similarity to any one of SEQ ID NOS: 965 and 1029-1031.

Aspect 32. The IL-7Rαγc ligand of any one of aspects 1 to 20, wherein the Rγc ligand comprises an amino acid sequence of SEQ ID NOS: 965 or 1029-1031.

Aspect 33. The IL-7Rαγc ligand of any one of aspects 1 to 20, wherein the Rγc ligand comprises a substituted amino acid sequence of SEQ ID NOS: 965 or 1029-1031.

Aspect 34. The IL-7Rαγc ligand of any one of aspects 1 to 20, wherein the IL-7Rα ligand comprises a truncated amino acid sequence of SEQ ID NOS: 965 or 1029-1031.

Aspect 35. The IL-7Rαγc ligand of any one of aspects 32 to 34, wherein from 1 to 5 of the amino acids of the IL-7Rα ligand are independently substituted with another amino acid.

Aspect 36. The IL-7Rαγc ligand of any one of aspects 32 to 35, wherein the amino acid sequence comprises from 1 to 4 glycines (G) (SEQ ID NO: 2045) on the N-terminus, on the C-terminus, or on both the N- and C-termini.

Aspect 37. The IL-7Rαγc ligand of any one of aspects 32 to 36, wherein the IL-7Rα ligand comprises an amino acid sequence having greater than 60% sequence similarity to SEQ ID NOS: 407 and 454-474.

Aspect 38. The IL-7Rαγc ligand of any one of aspects 32 to 37, wherein the Rγc ligand comprises an amino acid sequence having greater than 60% sequence similarity to SEQ ID NOS: 965 or 1029-1031.

Aspect 39. The IL-7Rαγc ligand of aspect 1, wherein,
the IL-7Rα ligand comprises an amino acid sequence selected from any one of SEQ ID NOS: 389-410, 420-556 and 9434-9437, a truncated amino acid sequence of any one of SEQ ID NOS: 389-410, 420-557 and 9434-9437, or an amino acid sequence having greater than 60% sequence similarity to any one of SEQ ID NOS: 389-410, 420-556 and 9434-9437; and
the Rγc ligand comprises an amino acid sequence selected from any one of SEQ ID NOS: 944-1031 and 9438-9443, a truncated amino acid sequence of any one of SEQ ID NOS: 944-1031 and 9438-9443, or an amino acid sequence having greater than 60% sequence similarity to any one of SEQ ID NOS: 944-1031 and 9438-9443.

Aspect 40. The IL-7Rαγc ligand of aspect 1, wherein,
the IL-7Rα ligand comprises the amino acid sequence of SEQ ID NOS: 407 and 454-474, a truncated amino acid sequence of SEQ ID NOS: 407 and 454-474, or an amino acid sequence having greater than 60% sequence similarity to SEQ ID NOS: 407 and 454-474; and
the Rγc ligand comprises the amino acid sequence of SEQ ID NOS: 965 or 1029-1031, a truncated amino acid sequence of SEQ ID NOS: 965 or 1029-1031, or an amino acid sequence having greater than 60% sequence similarity to SEQ ID NOS: 965 or 1029-1031.

Aspect 41. The IL-7Rαγc ligand of any one of aspects 1 to 40, wherein the IL-7Rα ligand comprises a disulfide bond between each of the two cysteines of the IL-7Rα ligand.

Aspect 42. The IL-7Rαγc ligand of any one of aspects 1 to 41, wherein the Rγc ligand comprises a disulfide bond between the two cysteines of the Rγc ligand.

Aspect 43. The IL-7Rαγc ligand of any one of aspects 1 to 40, wherein the IL-7Rαγc ligand comprises a disulfide bond between a cysteine of the IL-7Rα ligand and a cysteine of the Rγc ligand.

Aspect 44. The IL-7Rαγc ligand of any one of aspects 1 to 40, wherein each of the cysteines of the IL-7Rα ligand are bound to a cysteine of the Rγc ligand by a disulfide bond.

Aspect 45. The IL-7Rαγc ligand of any one of aspects 1 to 44, wherein the IL-7Rα ligand binds to a specific binding site of the IL-7Rα subunit, wherein,
(1) a group of IL-7Rα ligands bind to the unique binding site on the IL-7Rα subunit with an $IC_{50}$ of less than 10 µM;
(2) each of the IL-7Rα ligands within the group competitively bind to the unique binding site on the IL-7Rα subunit with each of other IL-7Rα ligands within the group; and
(3) a peptide having the amino acid sequence of SEQ ID NO: 965 does not compete for binding to the unique binding site on the IL-7Rα subunit with the peptides within the group of IL-7Rα ligands; and
(4) IL-7Rα ligands having SEQ ID NOS: 5, 43, 104, 146, and 313 do not bind competitively with IL-7 binding to IL-7Rα.

Aspect 46. The IL-7Rαγc ligand of any one of aspects 1 to 45, wherein,
the IL-7Rα ligand binds to the IL-7Rα subunit with an $IC_{50}$ of less than 100 µM; and
the IL-7Rα ligand binds to the Rγc subunit with an $IC_{50}$ of greater than 100 µM.

Aspect 47. The IL-7Rαγc ligand of any one of aspects 1 to 46, wherein the Rγc ligand binds to a specific binding site of the Rγc subunit, wherein,
(1) a group of Rγc ligands bind to the specific binding site on the Rγc subunit with an $IC_{50}$ of less than 10 µM;
(2) Rγc ligands within the group competitively bind to the specific binding site on the Rγc subunit with other Rγc ligands within the group;
(3) Rγc ligands within the group do not compete for binding to the specific binding site with an Rγc ligand having the amino acid sequence of SEQ ID NO: 930; and
(4) an Rα ligand having the amino acid sequence of SEQ ID NO: 58 does not compete for binding to the binding site with the group of Rγc ligands,
the group of Rγc ligands have SEQ ID NOS: 198, 202, 224, 236, 248, and 266.

Aspect 48. The IL-7Rαγc ligand of any one of aspects 1 to 47, wherein,
the Rγc ligand binds to the Rγc subunit with an $IC_{50}$ of less than 100 µM; and
the Rγc ligand binds to the Rα subunit with an $IC_{50}$ of greater than 100 µM.

Aspect 49. The IL-7Rαγc ligand of any one of aspects 1 to 48, wherein each of the C-terminus and/or the N-terminus of the IL-7Rα ligand independently comprises from 2 to 10 flanking amino acids.

Aspect 50. The IL-7Rαγc ligand of any one of aspects 1 to 49, wherein each of the C-terminus and/or the N-terminus of the IL-7Rα ligand independently comprises flanking amino acids selected from -G-, -GG- (SEQ ID NO: 9399), -GGG- (SEQ ID NO: 9400), and -GGGG- (SEQ ID NO: 9401).

Aspect 51. The IL-7Rαγc ligand of any one of aspects 1 to 48, wherein each of the C-terminus and/or the N-terminus of the Rγc ligand independently comprises from 2 to 10 flanking amino acids.

Aspect 52. The IL-7Rαγc ligand of any one of aspects 1 to 48, wherein each of the C-terminus and/or the N-terminus of the Rγc ligand independently comprises flanking amino acids selected from -G-, -GG- (SEQ ID NO: 9399), -GGG- (SEQ ID NO: 9400), and -GGGG- (SEQ ID NO: 9401).

Aspect 53. The IL-7Rαγc ligand of any one of aspects 1 to 52, wherein the IL-7Rαγc ligand further comprises a ligand linker bound to the IL-7Rα ligand and the Rγc ligand.

Aspect 54. The IL-7Rαγc ligand of aspect 53, wherein the C-terminus of the IL-7Rα ligand and the C-terminus of the Rγc ligand are bound to the IL-7Rαγc ligand linker.

Aspect 55. The IL-7Rαγc ligand of aspect 53, wherein the C-terminus of the IL-7Rα ligand and the N-terminus of the Rγc ligand are bound to the IL-7Rαγc ligand linker.

Aspect 56. The IL-7Rαγc ligand of aspect 53, wherein the N-terminus of the IL-7Rα ligand and the C-terminus of the Rγc ligand are bound to the IL-7Rαγc ligand linker.

Aspect 57. The IL-7Rαγc ligand of aspect 53, wherein the N-terminus of the IL-7Rα ligand and the N-terminus of the Rγc ligand are bound to the IL-7Rαγc ligand linker.

Aspect 58. The IL-7Rαγc ligand of any one of aspects 53 to 57, wherein the IL-7Rαγc ligand linker has a length from 5 Å to 200 Å.

Aspect 59. The IL-7Rαγc ligand of any one of aspects 53 to 58, wherein the IL-7Rαγc ligand linker is configured to facilitate binding of the IL-7Rαγc ligand to IL-7R.

Aspect 60. The IL-7Rαγc ligand of any one of aspects 53 to 59, wherein the IL-7Rαγc ligand linker is configured to activate IL-7R.

Aspect 61. The IL-7Rαγc ligand of any one of aspects 53 to 60, wherein the IL-7Rαγc ligand linker comprises a synthetic IL-7Rαγc ligand linker.

Aspect 62. The IL-7Rαγc ligand of aspect 61, wherein the synthetic IL-7Rαγc ligand linker comprises a triazole.

Aspect 63. The IL-7Rαγc ligand of any one of aspects 53 to 60, wherein the IL-7Rαγc ligand linker comprises a peptidyl IL-7Rαγc ligand linker.

Aspect 64. The IL-7Rαγc ligand of aspect 63, wherein the peptidyl IL-7Rαγc ligand linker comprises from 2 to 20 amino acids.

Aspect 65. The IL-7Rαγc ligand of any one of aspects 63 to 64, wherein the peptidyl IL-7Rαγc ligand linker comprises $(G)_n$ (SEQ ID NO: 9390), $(GS)_n$ (SEQ ID NO: 9391), $(GGS)_n$ (SEQ ID NO: 9392), $(GGGS)_n$ (SEQ ID NO: 9393), $(GGGGS)_n$ (SEQ ID NO: 9394), or a combination of any of the foregoing, wherein each n is independently an integer from 1 to 5.

Aspect 66. The IL-7Rαγc ligand of any one of aspects 53 to 65, wherein the IL-7Rαγc linker comprises a cleavable IL-7Rαγc ligand linker.

Aspect 67 The IL-7Rαγc ligand of any one of aspects 53 to 66, wherein the IL-7Rαγc ligand comprises:

an IL-7Rα ligand comprising the amino acid sequence of SEQ ID NOS: 407 and 454-474, a truncated amino acid sequence of SEQ ID NOS: 407 and 454-474, or an amino acid sequence having greater than 60% sequence similarity to SEQ ID NOS: 407 and 454-474; and an Rγc ligand comprising an amino acid sequence of SEQ ID NOS: 965 or 1029-1031, a truncated amino acid sequence of SEQ ID NOS: 965 or 1029-1031, or an amino acid sequence having greater than 60% sequence similarity to SEQ ID NOS: 965 or 1029-1031.

Aspect 68. The IL-7Rαγc ligand of aspect 57, wherein the IL-7Rαγc ligand linker comprises $(G)_n$ (SEQ ID NO: 9390), $(GS)_n$ (SEQ ID NO: 9391), $(GGS)_n$ (SEQ ID NO: 9392), $(GGGS)_n$ (SEQ ID NO: 9393), $(GGGGS)_n$ (SEQ ID NO: 9394), or a combination of any of the foregoing; wherein each n is independently an integer from 1 to 5.

Aspect 69. The IL-7Rαγc ligand of aspect 67, wherein the IL-7Rαγc ligand linker comprises -GGGGSGG-(SEQ ID NO: 9404).

Aspect 70. The IL-7Rαγc ligand of aspect 1, wherein the IL-7Rαγc ligand comprises the amino acid sequence of SEQ ID NOS: 2012-3023 and 2058-2132 or an amino acid sequence having greater that 60% sequence similarity to SEQ ID NOS: 2012-3023 and 2058-2132.

Aspect 71. The IL-7Rαγc ligand of aspect 70, wherein the IL-7Rαγc ligand comprises one or more flanking glycines.

Aspect 72. The IL-7Rαγc ligand of any one of aspects 70 to 71, wherein the amino acid sequence comprises from 1 to 5 substitutions.

Aspect 73. The IL-7Rαγc ligand of aspect 1, wherein the IL-7Rαγc ligand comprises the amino acid sequence of any one of SEQ ID NOS: 2012, 2084-2087, and 2091-2120 or an amino acid sequence having greater that 60% sequence similarity to any one of SEQ ID NOS: 2012, 2084-2087, and 2091-2120.

Aspect 74. The IL-7Rαγc ligand of aspect 73, wherein, the cysteines of the IL-7Rα ligand are bound to each other by a disulfide bond; and the cysteines of the Rγc ligand are bound to each other by a disulfide bond.

Aspect 75. The IL-7Rαγc ligand of any one of aspects 73 to 74, wherein the cysteines of the IL-7Rα ligand are bound to the cysteines of the Rγc ligand.

Aspect 76. The IL-7Rαγc ligand of any one of aspects 1 to 75, wherein the IL-7Rαγc ligand is a full IL-7R agonist.

Aspect 77. The IL-7Rαγc ligand of any one of aspects 1 to 75, wherein the IL-7Rαγc ligand is a partial IL-7R agonist.

Aspect 78. The IL-7Rαγc ligand of any one of aspects 1 to 75, wherein the IL-7Rαγc ligand is an IL-7R antagonist.

Aspect 79. The IL-7Rαγc ligand of any one of aspects 1 to 75, wherein the IL-7Rαγc ligand is an IL-7R agonist for the STAT5 phosphorylation pathway in TF-1-7α cells.

Aspect 80. A tandem IL-7Rαγc ligand, wherein the tandem IL-7Rαγc ligand comprises two or more of the IL-7Rαγc ligands of any one of aspects 1 to 79.

Aspect 81. The tandem IL-7Rαγc ligand of aspect 80, wherein each of the two or more IL-7Rαγc ligands is the same.

Aspect 82. The tandem IL-7Rαγc ligand of any one of aspects 80 to 81, wherein at least one of the two or more IL-7Rαγc ligands is different than another IL-7Rαγc ligand.

Aspect 83. The tandem IL-7Rαγc ligand of any one of aspects 80 to 82, wherein each of the two or more IL-7Rαγc ligands is bound to another IL-7Rαγc ligand through a tandem linker.

Aspect 84. The tandem IL-7Rαγc ligand of any one of aspects 80 to 83, wherein, the C-terminus of a first IL-7Rαγc ligand is bound to the tandem linker; and the N-terminus of a second IL-7Rαγc ligand is bound to the tandem linker.

Aspect 85. The tandem IL-7Rαγc ligand of any one of aspects 80 to 84, wherein the tandem linker comprises a peptidyl tandem linker.

Aspect 86. The tandem IL-7Rαγc ligand of aspect 85, wherein the peptidyl tandem linker comprises from 2 to 20 amino acids.

Aspect 87. The tandem IL-7Rαγc ligand of any one of aspects 85 to 86, wherein the peptidyl tandem linker has a length from 5 Å to 200 Å.

Aspect 88. An IL-7Rαγc ligand construct, wherein the IL-7Rαγc ligand construct comprises one or more of the IL-7Rαγc ligands of any one of aspects 1 to 79 bound to a construct partner.

Aspect 89. The IL-7Rαγc ligand construct of aspect 88, wherein, the IL-7Rαγc ligand construct comprises two or more IL-7Rαγc ligands; and each of the two or more IL-7Rαγc ligands is the same.

Aspect 90. The IL-7Rαγc ligand construct of aspect 88, wherein, the IL-7Rαγc ligand construct comprises two or more IL-7Rαγc ligands; and at least one of the two or more IL-7Rαγc ligands is different than at least one of the other IL-7Rαγc ligand.

Aspect 91. The IL-7Rαγc ligand construct of any one of aspects 88 to 90, further comprising a construct linker, wherein an IL-7Rαγc ligand is bound to the construct partner through the construct linker.

Aspect 92. The IL-7Rαγc ligand construct of aspect 91, wherein the IL-7Rαγc ligand is bound to the construct linker through the C-terminus of the IL-7Rαγc ligand.

Aspect 93. The IL-7Rαγc ligand construct of aspect 91, wherein the IL-7Rαγc ligand is bound to the construct linker through the N-terminus of the IL-7Rαγc ligand.

Aspect 94. The IL-7Rαγc ligand construct of aspect 91, wherein the construct linker comprises a peptidyl construct linker.

Aspect 95. The IL-7Rαγc ligand construct of aspect 94, wherein the peptidyl construct linker comprises from 2 to 200 amino acids.

Aspect 86. The IL-7Rαγc ligand construct of any one of aspects 94 to 95, wherein the peptidyl construct linker has a length from 5 Å to 200 Å.

Aspect 97. The IL-7Rαγc ligand construct of any one of aspects 94 to 96, wherein the peptidyl construct linker comprises $(G)_n$ (SEQ ID NO: 9380), (GS). (SEQ ID NO: 9381), $(GGS)_n$ (SEQ ID NO: 9382), $(GGGS)_n$ (SEQ ID NO: 9383), $(GGGGS)_n$ (SEQ ID NO: 9384), $(PA)_n$ (SEQ ID NO: 9421), or a combination of any of the foregoing, wherein each n is independently selected from an integer from 1 to 20.

Aspect 98. The IL-7Rαγc ligand construct of any one of aspects 88 to 97, wherein the construct linker comprises a cleavable construct linker.

Aspect 99. The IL-7Rαγc ligand construct of any one of aspects 88 to 98, wherein,
the construct partner comprises a polypeptide; and
the IL-7Rαγc ligand is bound to the C-terminus and/or to the N-terminus of the polypeptide.

Aspect 100. The IL-7Rαγc ligand construct of any one of aspects 88 to 99, wherein,
the construct partner comprises a polypeptide; and
the IL-7Rαγc ligand is bound to an amino acid side chain of the polypeptide.

Aspect 101. The IL-7Rαγc ligand construct of any one of aspects 88 to 100, wherein,
the construct partner comprises a polypeptide; and
the IL-7Rαγc ligand is incorporated into the polypeptide.

Aspect 102. The IL-7Rαγc ligand construct of any one of aspects 88 to 101, wherein the construct partner comprises a compound configured to impart a desired pharmacokinetic property to the IL-7Rαγc ligand in the systemic circulation of a patient.

Aspect 103. The IL-7Rαγc ligand construct of any one of aspects 88 to 102, wherein the construct partner comprises a compound configured to impart a desired biodistribution property to the IL-7Rαγc ligand in the body of a patient.

Aspect 104. The IL-7Rαγc ligand construct of any one of aspects 88 to 103, wherein the construct partner is selected from a polymer, a polypeptide, an Fc-fragment, an immunoglobulin fragment, and an antibody.

Aspect 105. The IL-7Rαγc ligand construct of any one of aspects 88 to 103, wherein the construct partner comprises a vaccine.

Aspect 106. The IL-7Rαγc ligand construct of any one of aspects 88 to 103, wherein the construct partner comprises a viral surface antigen or a virus like particle.

Aspect 107. The IL-7Rαγc ligand construct of any one of aspects 88 to 103, wherein the construct partner is selected from a human serum albumin, a polypeptide, and a polyethylene glycol.

Aspect 108. The IL-7Rαγc ligand construct of any one of aspects 88 to 103, wherein the IL-7Rαγc ligand construct comprises a recombinant fusion protein.

Aspect 109. The IL-7Rαγc ligand construct of any one of aspects 88 to 108, wherein the IL-7Rαγc ligand construct comprises an amino acid sequence selected from any one of SEQ ID NOS: 2012-2023 and 2058-2132, or an amino acid sequence having greater than 60% sequence similarity to any one of SEQ ID NOS: 2012-2023 and 2058-2132.

Aspect 110. The IL-7Rαγc ligand construct of any one of aspects 88 to 108, wherein the IL-7Rαγc ligand comprises an amino acid sequence of any one of SEQ ID NOS: 2012-2023 and 2058-2132 or an amino acid sequence having greater than 60% sequence similarity to an amino acid sequence of any one of SEQ ID NOS: 2012-2023 and 2058-2132.

Aspect 111. The IL-7Rαγc ligand construct of any one of aspects 88 to 108, wherein the IL-7Rαγc ligand comprises an amino acid sequence of SEQ ID NOS: 2012, 2084-2087, and 2091-2120 or an amino acid sequence having greater than 60% sequence similarity to SEQ ID NOS: 2012, 2084-2087, and 2091-2120.

Aspect 112. The IL-7Rαγc ligand construct of any one of aspects 88 to 103, wherein the construct partner comprises an Fc-fragment.

Aspect 113. The IL-7Rαγc ligand construct of aspect 112, wherein the Fc-fragment is derived from IgG1, IgG2, or IgG4, or a mutant of any of the foregoing.

Aspect 114. The IL-7Rαγc ligand construct of any one of aspects 112 to 113, wherein the IL-7Rαγc ligand is bound to a C-terminus of the Fc-fragment.

Aspect 115. The IL-7Rαγc ligand construct of any one of aspects 112 to 113, wherein the IL-7Rαγc ligand is bound to a N-terminus of the Fc-fragment.

Aspect 116. The IL-7Rαγc ligand construct of aspect 115, wherein the IL-7Rαγc ligand is bound to the Fc-fragment though an Fc-fragment linker.

Aspect 117. The IL-7Rαγc ligand construct of aspect 116, wherein the Fc-fragment linker comprises a peptidyl Fc-fragment linker.

Aspect 118. The IL-7Rαγc ligand construct of any one of aspects 115 to 116, wherein the peptidyl Fc-fragment linker comprises from 2 to 200 amino acids.

Aspect 119. The IL-7Rαγc ligand construct of any one of aspects 115 to 128, wherein the peptidyl Fc-fragment linker has a length from 5 to 200 Å.

Aspect 120. The IL-7Rαγc ligand construct of any one of aspects 115 to 119, wherein the peptidyl Fc-fragment linker comprises $(G)_n$ (SEQ ID NO: 9380), $(GS)_n$ (SEQ ID NO: 9381), $(GGS)_n$ (SEQ ID NO: 9382), $(GGGS)_n$ (SEQ ID NO: 9383), $(GGGGS)_n$ (SEQ ID NO: 9384), $(PA)_n$ (SEQ ID NO: 9421), or a combination of any of the foregoing, wherein n is independently an integer from 1 to 20.

Aspect 121. The IL-7Rαγc ligand construct of any one of aspects 88 to 103, wherein the construct partner is an immunoglobulin fragment.

Aspect 122. The IL-7Rαγc ligand construct of aspect 121, wherein the immunoglobulin fragment is selected from an IgG1 fragment, an IgG2 fragment, and an IgG4 fragment.

Aspect 123. The IL-7Rαγc ligand construct of any one of aspects 121 to 122, wherein the IL-7Rαγc ligand is bound to a C-terminus of the immunoglobulin fragment.

Aspect 124. The IL-7Rαγc ligand construct of any one of aspects 121 to 123, wherein the IL-7Rαγc ligand is bound to an N-terminus of the immunoglobulin fragment.

Aspect 125. The IL-7Rαγc ligand construct of any one of aspects 121 to 124, wherein the IL-7Rαγc ligand is bound to the immunoglobulin fragment though an immunoglobulin linker.

Aspect 126. The IL-7Rαγc ligand construct of any one of aspects 121 to 125, wherein the immunoglobulin linker comprises a peptidyl immunoglobulin linker.

Aspect 127. The IL-7Rαγc ligand construct of aspect 126, wherein the peptidyl immunoglobulin linker comprises from 2 to 200 amino acids.

Aspect 128. The IL-7Rαγc ligand construct of any one of aspects 121 to 127, wherein the peptidyl immunoglobulin linker has a length from 5 to 200 Å.

Aspect 129. The IL-7Rαγc ligand construct of any one of aspects 121 to 128, wherein the peptidyl immunoglobulin linker comprises $(G)_n$ (SEQ ID NO: 9380), (GS). (SEQ ID NO: 9381), $(GGS)_n$ (SEQ ID NO: 9382), $(GGGS)_n$ (SEQ ID NO: 9383), $(GGGGS)_n$ (SEQ ID NO: 9384), $(PA)_n$ (SEQ ID NO: 9421), or a combination of any of the foregoing, wherein n is independently an integer from 1 to 20.

Aspect 130. The IL-7Rαγc ligand construct of any one of aspects 121 to 129, wherein at least one IL-7Rαγc ligand is bound to an immunoglobulin heavy chain.

Aspect 131. The IL-7Rαγc ligand construct of any one of aspects 121 to 130, wherein at least one IL-7Rαγc ligand is bound to an immunoglobulin light chain.

Aspect 132. The IL-7Rαγc ligand construct of any one of aspects 88 to 103, wherein the construct partner comprises an antibody.

Aspect 133. The IL-7Rαγc ligand construct of aspect 132, wherein the antibody is directed to a tumor antigen.

Aspect 134. The IL-7Rαγc ligand construct of aspect 133, wherein the tumor antigen is selected from CEA and FAP.

Aspect 135. The IL-7Rαγc ligand construct of any one of aspects 132 to 134, wherein the antibody is directed to a checkpoint inhibitor.

Aspect 136. The IL-7Rαγc ligand construct of aspect 135, wherein the checkpoint inhibitor is PD-1.

Aspect 137. The IL-7Rαγc ligand construct of aspect 136, wherein in the PD-1 antibody is selected from cemiplimab and pembrolizumab.

Aspect 138. The IL-7Rαγc ligand construct of any one of aspects 132 to 137, wherein the antibody is directed to a cell-specific antigen.

Aspect 139. The IL-7Rαγc ligand construct of aspect 138, wherein the cell-specific antigen is selected from CD25, NK62D, and CD8.

Aspect 140. The IL-7Rαγc ligand construct of any one of aspects 132 to 139, wherein the antibody further comprises a cytokine.

Aspect 141. The IL-7Rαγc ligand construct of aspect 140, wherein the cytokine comprises an interleukin.

Aspect 142. The IL-7Rαγc ligand construct of any one of aspects 88 to 103, wherein the IL-7Rαγc ligand construct comprises a cell-targeting moiety.

Aspect 143. The IL-7Rαγc ligand construct of aspect 142, wherein the cell-targeting moiety comprises a tumor-targeting moiety.

Aspect 144. The IL-7Rαγc ligand construct of aspect 142, wherein the cell-targeting moiety comprises an immune cell-targeting moiety.

Aspect 145. The IL-7Rαγc ligand construct of any one of aspects 88 to 103, wherein the IL-7Rαγc ligand construct further comprises a ubiquitin-like modifier.

Aspect 146. The IL-7Rαγc ligand construct of any one of aspects 88 to 103, wherein the IL-7Rαγc ligand construct further comprises a therapeutically effective moiety in addition to the IL-7Rαγc ligand.

Aspect 147. The IL-7Rαγc ligand construct of any one of aspects 88 to 146, wherein the IL-7Rαγc ligand construct is a full IL-7R agonist.

Aspect 148. The IL-7Rαγc ligand construct of any one of aspects 88 to 146, wherein the IL-7Rαγc ligand construct is a partial IL-7R agonist.

Aspect 149. The IL-7Rαγc ligand construct of any one of aspects 88 to 146, wherein the IL-7Rαγc ligand construct is an IL-7R antagonist.

Aspect 150. An IL-7Rαγc ligand construct, wherein the IL-7Rαγc ligand construct comprises a construct partner, at least one IL-7Rα ligand bound to the construct partner, and at least one Rγc ligand bound to the construct partner, wherein, (a) the at least one IL-7Rα ligand comprises:
  an amino acid sequence of Formula (1), Formula (1a), Formula (1b), or Formula (1c);
  a truncated amino acid sequence of Formula (1), Formula (1a), Formula (1b), or Formula (1c); or
  an amino acid sequence having greater than 60% sequence similarity to an amino acid sequence of Formula (1) (SEQ ID NO: 389), Formula (1a) (SEQ ID NO: 390), Formula (1b) (SEQ ID NO: 391), or Formula (1c) (SEQ ID NO: 392):

(1)
$-X^{201}-X^{202}-X^{203}-X^{204}-X^{205}-X^{206}-X^{207}-X^{208}-X^{209}-X^{210}-X^{211}-X^{212}-X^{213}-X^{214}-X^{215}-X^{216}-$ (1a)
$-X^{202}-X^{203}-X^{204}-X^{205}-X^{206}-X^{207}-X^{208}-X^{209}-X^{210}-X^{211}-X^{212}-X^{213}-X^{214}-X^{215}-$ (1b)
$-X^{203}-X^{204}-X^{205}-X^{206}-X^{207}-X^{208}-X^{209}-X^{210}-X^{211}-X^{212}-X^{213}-X^{214}-$ (1c)
$-X^{204}-X^{205}-X^{206}-X^{207}-X^{208}-X^{209}-X^{210}-X^{211}-X^{212}-X^{213}-$ wherein,
$X^{201}$ is selected from H, I, Q, and V;
$X^{202}$ is selected from C, P, and R;
$X^{203}$ is selected from I, K, L, S, V, and W;
$X^{204}$ is selected from C and H;
$X^{205}$ is selected from A, I, L, M, T, and W;
$X^{206}$ is selected from D, L, and W;
$X^{207}$ is selected from D, I, L, and Q;
$X^{208}$ is selected from D, E, and P;
$X^{209}$ is selected from G, S, and T;
$X^{210}$ is selected from A, G, L, and S;
$X^{211}$ is selected from F, I, L, and M;
$X^{212}$ is selected from G, H, L, N, Q, and S;
$X^{213}$ is C;
$X^{214}$ is selected from A, E, I, L, S, T, and V;
$X^{215}$ is selected from F, R, W, and Y; and
$X^{216}$ is selected from E, L, Q, and W; and (b) the at least one Rγc ligand, wherein the Rγc ligand comprises:
an amino acid sequence of Formula (3), Formula (3a), Formula (3b), Formula (3c), Formula (3d), or Formula (3e);
a truncated amino acid sequence of Formula (3), Formula (3a), Formula (3b), Formula (3c), Formula (3d), or Formula (3e); or
or an amino acid sequence having greater than 60% sequence similarity to an amino acid sequence of Formula (3) (SEQ ID NO: 944), Formula (3a) (SEQ ID NO: 945), Formula (3b) (SEQ ID NO: 946), Formula (3c) (SEQ ID NO: 947), Formula (3d) (SEQ ID NO: 948), or Formula (3e) (SEQ ID NO: 949):.

(3)
$-X^{171}-X^{172}-X^{173}-X^{174}-X^{175}-C-X^{176}-X^{177}-X^{178}-X^{179}-X^{180}-X^{181}-X^{182}-X^{183}-C-X^{184}-X^{185}-X^{186}-X^{187}-X^{188}-$ (3a)
$-X^{172}-X^{173}-X^{174}-X^{175}-C-X^{176}-X^{177}-X^{178}-X^{179}-X^{180}-X^{181}-X^{182}-X^{183}-C-X^{184}-X^{185}-X^{186}-X^{187}-$ (3b)
$-X^{173}-X^{174}-X^{175}-C-X^{176}-X^{177}-X^{178}-X^{179}-X^{180}-X^{181}-X^{182}-X^{183}-C-X^{184}-X^{185}-X^{186}-$ (3c)
$-X^{174}-X^{175}-C-X^{176}-X^{177}-X^{178}-X^{179}-X^{180}-X^{181}-X^{182}-X^{183}-C-X^{184}-X^{185}-$ (3d)
$-X^{175}-C-X^{176}-X^{177}-X^{178}-X^{179}-X^{180}-X^{181}-X^{182}-X^{183}-C-X^{184}-$ (3e)
$-C-X^{176}-X^{177}-X^{178}-X^{179}-X^{180}-X^{181}-X^{182}-X^{183}-C-$ wherein,
$X^{171}$ is selected from H, K, and R;
$X^{172}$ is selected from S, T, and Y;
$X^{173}$ is selected from D, E, F, I, L, M, V, W, and Y;
$X^{174}$ is selected from F, I, L, M, V, W, and Y;
$X^{175}$ is selected from D, E, F, I, L, M, V, W, and Y;
$X^{176}$ is selected from D, E, H, N, Q, S, T, and Y;
$X^{177}$ is selected from D and E;
$X^{178}$ is selected from F, H, I, L, M, V, W, and Y;
$X^{179}$ is selected from D, E, H, N, Q, S, T, and Y;
$X^{180}$ is G;
$X^{181}$ is V;
$X^{182}$ is E;
$X^{183}$ is L;
$X^{184}$ is selected from W;
$X^{185}$ is selected from F, I, L, M, V, W, Y, H, N, Q, S, and T;
$X^{186}$ is E;
$X^{187}$ is selected from an amino acid; and
$X^{188}$ is selected from D and E.

Aspect 151. The IL-7Rαγc ligand construct of aspect 150, comprising an IL-7Rαγc ligand bound to the construct partner, wherein the IL-7Rαγc ligand comprises an IL-7Rαγc ligand linker and an IL-7Rα ligand and an Rγc ligand bound to the IL-7Rαγc ligand linker.

Aspect 152. The IL-7Rαγc ligand construct of any one of aspects 150 to 151, wherein,
the IL-7Rα ligand comprises the amino acid sequence of SEQ ID NOS: 407 and 454-474, a truncated amino acid sequence of SEQ ID NOS: 407 and 454-474, or an amino acid sequence having a greater than 60% sequence similarity to SEQ ID NOS: 407 and 454-474; and
the Rγc ligand comprises the amino acid sequence of SEQ ID NOS: 965 or 1029-1031, a truncated amino acid sequence of SEQ ID NOS: 965 or 1029-1031 or an amino acid sequence having a greater than 60% sequence similarity to SEQ ID NOS: 965 or 1029-1031.

Aspect 153. The IL-7Rαγc ligand construct of any one of aspects 150 to 152, wherein, the cysteines of the IL-7Rα ligand are bound to each other by a disulfide bond; and the cysteines of the Rγc ligand are bound to each other by a disulfide bond.

Aspect 154. The IL-7Rαγc ligand construct of any one of aspects 150 to 153, wherein each of the at least one IL-7Rα ligands and each of the at least one Rγc ligands are bound to the construct partner through a construct linker.

Aspect 155. The IL-7Rαγc ligand construct of any one of aspects 150 to 154, wherein, each of the at least one IL-7Rα ligands is the same; and each of the at least one Rγc ligands is the same.

Aspect 156. The IL-7Rαγc ligand construct of any one of aspects 150 to 154, wherein, at least one of the IL-7Rα ligands is different than at least one of the other IL-7Rα ligands; and/or at least one of the Rγc ligands is different than at least one of the other Rγc ligands.

Aspect 157. The IL-7Rαγc ligand construct of any one of aspects 150 to 156, wherein the construct partner comprises an Fc fragment, an immunoglobulin fragment, or an immunoglobulin.

Aspect 158. The IL-7Rαγc ligand construct of any one of aspects 150 to 156, wherein the construct partner comprises a polypeptide or a polymer.

Aspect 159. The IL-7Rαγc ligand construct of any one of aspects 150 to 158, further comprising at least one IL-7Rαγc ligand, wherein the at least one IL-7Rαγc ligand is bound to the construct partner.

Aspect 160. A method of treating cancer in a patient comprising administering to a patient in need of such treatment a therapeutically effective amount of the IL-7Rαγc ligand of any one of any one of aspects 1 to 79, the tandem IL-7Rαγc ligand of any one of aspects 80 to 87, the IL-7Rαγc ligand construct of any one of aspects 88 to 149, the IL-7Rαγc ligand construct of any one of aspects 150 to 159, or a combination of any of the foregoing.

Aspect 161. A method of treating an autoimmune disease in a patient comprising administering to a patient in need of such treatment a therapeutically effective amount of the IL-7Rαγc ligand of any one of any one of aspects 1 to 79, the tandem IL-7Rαγc ligand of any one of aspects 80 to 87, the IL-7Rαγc ligand construct of any one of aspects 88 to 149, the IL-7Rαγc ligand construct of any one of aspects 150 to 159, or a combination of any of the foregoing.

Aspect 162. A method of treating an inflammatory disease in a patient comprising administering to a patient in need of such treatment a therapeutically effective amount of the IL-7Rαγc ligand of any one of aspects 1 to 79, the tandem IL-7Rαγc ligand of any one of aspects 80 to 87, the IL-7Rαγc ligand construct of any one of aspects 88 to 149, the IL-7Rαγc ligand construct of any one of aspects 150 to 159, or a combination of any of the foregoing.

Aspect 163. A method of expanding immune cells comprising contacting a population of immune cells ex vivo or in vivo with an effective amount of the IL-7Rαγc ligand of any one of any one of aspects 1 to 79, the tandem IL-7Rαγc ligand of any one of aspects 80 to 87, the IL-7Rαγc ligand construct of any one of aspects 88 to 149, the IL-7Rαγc ligand construct of any one of aspects 150 to 159, or a combination of any of the foregoing.

Aspect 164. A method of expanding immune cells comprising contacting a population of immune cells ex vivo or in vivo with an effective amount of the IL-7Rαγc ligand of any one of any one of aspects 1 to 79, the tandem IL-7Rαγc ligand of any one of aspects 80 to 87, the IL-7Rαγc ligand construct of any one of aspects 88 to 149, the IL-7Rαγc ligand construct of any one of aspects 150 to 159, or a combination of any of the foregoing.

Aspect 165. A method of boosting a vaccine comprising administering to a patient a vaccine and a therapeutically effective amount of the IL-7Rαγc ligand of any one of any one of aspects 1 to 79, the tandem IL-7Rαγc ligand of any one of aspects 80 to 87, the IL-7Rαγc ligand construct of any one of aspects 88 to 149, the IL-7Rαγc ligand construct of any one of aspects 150 to 159, or a combination of any of the foregoing.

Aspect 166. A method of modifying the immune response comprising administering to a patient an effective amount of the IL-7Rαγc ligand of any one of aspects 1 to 79, the tandem IL-7Rαγc ligand of any one of aspects 80 to 87, the IL-7Rαγc ligand construct of any one of aspects 88 to 149, the IL-7Rαγc ligand construct of any one of aspects 150 to 159, or a combination of any of the foregoing.

Aspect 167. A pharmaceutical composition comprising the IL-7Rαγc ligand of any one of aspects 1 to 79, the tandem IL-7Rαγc ligand of any one of aspects 80 to 87, the IL-7Rαγc ligand construct of any one of aspects 88 to 149, the IL-7Rαγc ligand construct of any one of aspects 150 to 159, or a combination of any of the foregoing.

Aspect 168. The pharmaceutical composition of aspect 167, further comprising a chemotherapeutic agent, an immunomodulator, a checkpoint inhibitor, a vaccine, or a combination of any of the foregoing.

Aspect 169. A nucleic acid encoding for the IL-7Rαγc ligand of any one of aspects 1 to 79, the tandem IL-7Rαγc ligand of any one of aspects 80 to 87, the IL-7Rαγc ligand construct of any one of aspects 88 to 149, the IL-7Rαγc ligand construct of any one of aspects 150 to 159, or a combination of any of the foregoing.

Aspect 170. A nucleic acid encoding for an IL-7Rα ligand, wherein the IL-7Rα ligand comprises an amino acid sequence selected from any one of SEQ ID NOS: 389-410, 420-556 and 9434-9437, a truncated amino acid sequence of any one of SEQ ID NOS: 389-410, 420-556 and 9434-9437, or an amino acid sequence having greater than 60% amino acid sequence similarity to any one of SEQ ID NOS: 389-410 420-556 and 9434-9437.

Aspect 171. A nucleic acid encoding for an IL-7Rα ligand, wherein the IL-7Rα ligand comprises an amino acid sequence of SEQ ID NOS: 407 and 454-474, a truncated amino acid sequence of SEQ ID NOS: 407 and 454-474, or an amino acid sequence having greater than 60% amino acid sequence similarity to of: SEQ ID NOS: 407 and 454-474.

Aspect 172. A nucleic acid encoding for the Rγc ligand, wherein the Rγc ligand comprises an amino acid sequence selected from any one of SEQ ID NOS: 944-1031 and 9438-9443, a truncated amino acid sequence of any one of SEQ ID NOS: 944-1031 and 9438-9443, or an amino acid sequence having greater than 60% amino acid sequence similarity to any one of SEQ ID NOS: 944-1031 and 9438-9443.

Aspect 173. A nucleic acid encoding for the Rγc ligand, wherein the Rγc ligand comprises an amino acid sequence of SEQ ID NOS: 965 or 1029-1031, a truncated amino acid sequence of SEQ ID NOS: 965 or 1029-1031, or an amino acid sequence having greater than 60% amino acid sequence similarity to SEQ ID NOS: 965 or 1029-1031.

Aspect 174. A nucleic acid encoding for the IL-7Rαγc ligand of any one of aspects 1 to 79.

Aspect 175. The nucleic acid of aspect 174, wherein the IL-7Rαγc ligand comprises:

an IL-7Rα ligand comprising the amino acid sequence of SEQ ID NOS: 407 and 454-474, a truncated amino acid sequence of SEQ ID NOS: 407 and 454-474, or an amino acid sequence having greater than 60% amino acid sequence similarity to SEQ ID NOS: 407 and 454-474; and an Rγc ligand comprising the amino acid sequence of SEQ ID NOS: 965 or 1029-1031, a truncated amino acid sequence of SEQ ID NOS: 965 or 1029-1031, or an amino acid sequence having greater than 60% amino acid sequence similarity to SEQ ID NOS: 965 or 1029-1031.

Aspect 176. The nucleic acid of aspect 174, wherein the IL-7Rαγc ligand comprises an amino acid sequence of any one of SEQ ID NOS: 2012, 2084-2087, and 2091-2120, a truncated amino acid sequence of any one of SEQ ID NOS: 2012, 2084-2087, and 2091-2120, or an amino acid sequence having greater than 60% amino acid sequence similarity to any one of SEQ ID NOS: 2012, 2084-2087, and 2091-2120.

Aspect 177. The nucleic acid of aspect 174, wherein the IL-7Rαγc ligand comprises an amino acid sequence comprising SEQ ID NOS: 2012, 2084-2087, and 2091-2120, a truncated amino acid sequence of SEQ ID NOS: 2012, 2084-2087, and 2091-2120, or an amino acid sequence having greater than 60% amino acid sequence similarity to SEQ ID NOS: 2012, 2084-2087, and 2091-2120.

Aspect 178. A nucleic acid encoding for the tandem IL-7Rαγc ligand of aspect 177, wherein,
each of the IL-7Rαγc ligand linkers independently comprises a peptidyl IL-7Rαγc ligand linker; and
each of the tandem linkers independently comprises a peptidyl tandem linker.

Aspect 179. A nucleic acid encoding for the IL-7Rαγc ligand construct of any one of aspects 88 to 149, wherein the construct linker comprises a peptidyl construct linker.

Aspect 180. A nucleic acid encoding for the IL-7Rαγc ligand construct of aspect 179, wherein the IL-7Rαγc ligand construct comprises an amino acid sequence having greater than 60% amino acid sequence similarity to any one of SEQ ID NOS: 1212-1217, 1219, and 124-1252.

Aspect 181. A nucleic acid encoding for the IL-7Rαγc ligand construct, wherein the IL-7Rαγc ligand construct comprises an amino acid sequence selected from of any one of SEQ ID NOS: 1212-1217, 1219, and 124-1252.

Aspect 182. A nucleic acid encoding for the IL-7Rαγc ligand construct of any one of aspects 88 to 149.

Aspect 183. An IL-7Rα ligand, wherein the IL-7Rα ligand comprises an amino acid sequence of Formula (2) (SEQ ID NO: 500), an amino acid sequence of Formula (2a) (SEQ ID NO: 501), an amino acid sequence of Formula (2b) (SEQ ID NO: 502), an amino acid sequence of Formula (2c) (SEQ ID NO: 503), an amino acid sequence of Formula (2d) (SEQ ID NO: 504), an amino acid sequence of Formula (2e) (SEQ ID NO: 505), an amino acid sequence of Formula (2f) (SEQ ID NO: 506), or an amino acid sequence of Formula (2g) (SEQ ID NO: 507):

(2)
$-X^{198}-X^{199}-X^{200}-I-P-W-C-T-L-D-P-G-X^{210}-L-Q-C-A-W-L-X^{217}-X^{218}-X^{219}-$ (2a)
$-X^{199}-X^{200}-I-P-W-C-T-L-D-P-G-X^{210}-L-Q-C-A-W-L-X^{217}-X^{218}-X^{219}-$ (2b)
$-X^{200}-I-P-W-C-T-L-D-P-G-X^{210}-L-Q-C-A-W-L-X^{217}-X^{218}-X^{209}-$ (2d)
$-I-P-W-C-T-L-D-P-G-X^{210}-L-Q-C-A-W-L-X^{217}-X^{218}-X^{219}-$ (2d)
$-X^{198}-X^{199}-X^{200}-I-P-W-C-T-L-D-P-G-X^{210}-L-Q-C-A-W-L-X^{217}-X^{218}-$ (2e)
$-X^{198}-X^{199}-X^{200}-I-P-W-C-T-L-D-P-G-X^{210}-L-Q-C-A-W-L-X^{217}-$ (2f)
$-X^{198}-X^{199}-X^{200}-I-P-W-C-T-L-D-P-G-X^{210}-L-Q-C-A-W-L-$ (2g)
$-X^{198}-X^{199}-X^{200}-I-P-W-C-T-L-D-P-X^{210}-L-Q-C-A-W-L-$ wherein,
$X^{198}$ is selected from A, G, P, S, T and V;
$X^{199}$ is selected from F, H, W, and Y;
$X^{200}$ is selected from A, G, H, K, P, R, S, and T;
$X^{210}$ is selected form A, G, P, S, and T;
$X^{217}$ is selected from A, G, H, K, P, R, S, and T;
$X^{218}$ is selected from an amino acid and a single bond; and
$X^{219}$ is selected from an amino acid and a single bond.

Aspect 184. The IL-7Rαγc ligand of aspect 183, wherein,
$X^{198}$ is selected from V and G;
$X^{199}$ is selected from H and W;
$X^{200}$ is selected from R and G;
$X^{210}$ is selected form G and S;
$X^{217}$ is selected from R and G;
$X^{218}$ is selected from Q, G, K and a single bond; and
$X^{219}$ is selected from G, H, M, and a single bond.

Aspect 185. The IL-7Rαγc ligand of any one of aspects 183 to 184, wherein $X^{198}$ is V, $X^{199}$ is H, and $X^{200}$ is R.

Aspect 186. The IL-7Rαγc ligand of any one of aspects 183 to 184, wherein $X^{198}$ is G, $X^{199}$ is W, and $X^{200}$ is G Aspect 187. The IL-7Rαγc ligand of any one of aspects 183 to 186, wherein $X^{210}$ is G.

Aspect 188. The IL-7Rαγc ligand of any one of aspects 183 to 186, wherein $X^{210}$ is S.

Aspect 189. The IL-7Rαγc ligand of any one of aspects 183 to 188, wherein $X^{217}$ is R.

Aspect 190. The IL-7Rαγc ligand of any one of aspects 183 to 188, wherein $X^{217}$ is R, $X^{218}$ is Q, and $X^{219}$ is M.

Aspect 191. The IL-7Rαγc ligand of any one of aspects 183 to 188, wherein $X^{217}$ is G, $X^{218}$ is K, and $X^{219}$ is H.

Aspect 192. The IL-7Rαγc ligand of any one of aspects 183 to 191, wherein the IL-7Rα ligand comprises from 1 to 5 flanking glycines on the the N-terminus and/or the C-terminus.

Aspect 193. The IL-7Rαγc ligand of any one of aspects 183 to 191, wherein the ligand comprises an amino acid sequence or a truncated amino acid sequence selected from any one of SEQ ID NOS: 500-507.

Aspect 194. The IL-7Rαγc ligand of any one of aspects 183 to 191, wherein the ligand comprises an amino acid sequence selected from any one of SEQ ID NOS: 500-507, or a truncated amino acid sequence of any one of SEQ ID NOS: 500-507, wherein the amino acid sequence independently comprises from 1 to 4 glycines (G) (SEQ ID NO: 2045) on the N-terminus, on the C-terminus, or on both the N- and C-termini.

Aspect 195. The IL-7Rαγc ligand of any one of aspects 183 to 191, wherein the ligand comprises an amino acid sequence selected from any one of SEQ ID NOS: 500-507, or a truncated amino acid sequence of any one of SEQ ID NOS: 500-507, wherein the amino acid sequence comprises one or more amino acid substitutions such as from 1 to 5 amino acid substitutions.

Aspect 196. The IL-7Rαγc ligand of any one of aspects 183 to 191, wherein the ligand comprises an amino acid sequence or a truncated amino acid sequence similarity greater than 60%, greater than 70%, greater than 75%, greater than 80%, greater than 85%, greater than 90%, or greater than 95% to the amino acid sequence of any one of SEQ ID NOS: 500-507.

Aspect 197. The IL-7Rαγc ligand of any one of aspects 183 to 196, wherein the ligand binds to the hIL-7Rα subunit with an $IC_{50}$ of less than 10 μM as determined using phage ELISA competition assays.

Aspect 198. The IL-7Rαγc ligand of any one of aspects 183 to 197, wherein binds to a unique binding site on the IL-7Rα subunit that is different from the binding site on the IL-7Rα subunit to which IL-7 binds.

Aspect 199. An IL-7Rαγc ligand, wherein the ligand comprises an amino acid sequence selected from any one of SEQ ID NO: 2110-2124:

```
                                        SEQ ID NO: 2110
VHRIPWCTLDPGGLQCAWLRQM-X400-VVCQDWEGVELCWQ

SEQ ID NO: 2111
VHRIPWCTLDPGGLQCAWLRQ-X400-VVCQDEGVELCWQ

SEQ ID NO: 2112
VHRIPWCTLDPGGLQCAWLR-X400-VVCQDWGVELCWQ

SEQ ID NO: 2113
VHRIPWCTLDPGGLQCAWLGKH-X400-VVCQWEGVELCWQ

SEQ ID NO: 2114
VHRIPWCTLDPGGLQCAWLRM-X400-VVCQDWGVELCWQ

SEQ ID NO: 2115
GWGIPWCTLDPGGLQCAWLRQM-X400-VVCQDWEGVELCWQ

SEQ ID NO: 2116
GWGIPWCTLDPGGLQCAWLRQ-X400-VVCQDEGVELCWQ

SEQ ID NO: 2117
GWGIPWCTLDPGGLQCAWLR-X400-VVCQDWGVELCWQ

SEQ ID NO: 2118
GWGIPWCTLDPGGLQCAWLGKH-X400-VVCQWEGVELCWQ

SEQ ID NO: 2119
GWGIPWCTLDPGGLQCAWLRM-X400-VVCQDWGVELCWQ

SEQ ID NO: 2120
IPWCTLDPGGLQCAWLRQM-X400-VVCQDWEGVELCWQ

SEQ ID NO: 2121
IPWCTLDPGGLQCAWLRQ-X400-VVCQDEGVELCWQ

SEQ ID NO: 2122
IPWCTLDPGGLQCAWLR-X400-VVCQDWGVELCWQ

SEQ ID NO: 2123
IPWCTLDPGGLQCAWLGKH-X400-VVCQWEGVELCWQ

SEQ ID NO: 2124
IPWCTLDPGGLQCAWLRM-X400-VVCQDWGVELCWQ
``` wherein $X^{400}$ is selected from, for example, $(G)_n$ (SEQ ID NO: 9390), $(GS)_n$ (SEQ ID NO: 9391), $(GGS)_n$ (SEQ ID NO: 9392), $(GGGS)_n$ (SEQ ID NO: 9393), $(GGGGS)_n$ (SEQ ID NO: 9394) or a combination of any of the foregoing, where n is independently be an integer from 1 to 5.

Aspect 200. The IL-7Rαγc ligand of aspect 199, wherein $X^{400}$ is -GGGGSGG- (SEQ ID NO: 9404).

Aspect 201. The IL-7Rαγc ligand of any one of aspects 199 to 200, wherein the ligand comprises flanking glycines on each terminus such as two flanking glycines on one or both termini.

Aspect 202. The IL-7Rαγc ligand of any one of aspects 199 to 202, wherein the ligand comprises a truncated amino acid sequence of any one of SEQ ID NOS: 2110-2124.

Aspect 203. The IL-7Rαγc ligand of any one of aspects 199 to 202, wherein the ligand comprises an amino acid sequence selected from any one of SEQ ID NOS: 2110-2124, or a truncated amino acid sequence of any one of SEQ ID NOS: 2110-2124, wherein the amino acid sequence independently comprises from 1 to 4 glycines (G) (SEQ ID NO: 2045) on the N-terminus, on the C-terminus, or on both the N- and C-termini.

Aspect 204. The IL-7Rαγc ligand of any one of aspects 199 to 202, wherein the ligand comprises an amino acid sequence selected from any one of SEQ ID NOS: 2110-2124, or a truncated amino acid sequence of any one of SEQ ID NOS: 2110-2124, wherein the amino acid sequence comprises one or more amino acid substitutions such as from 1 to 5 amino acid substitutions. An amino acid substitution is a conservative amino acid substitution.

Aspect 205. The IL-7Rαγc ligand of any one of aspects 199 to 204, wherein the ligand binds to the human Rγc subunit with an IC50 of less than 100 μM.

Aspect 206. The IL-7Rαγc ligand of any one of aspects 199 to 205, wherein the ligand comprises an amino acid sequence having an amino acids similarity greater than 60%, greater than 70%, greater than 75%, greater than 80%, greater than 85%, greater than 90%, or greater than 95% to the amino acid sequence of any one of SEQ ID NOS: 2110-2124.

Aspect 207. The IL-7Rαγc ligand of any one of aspects 199 to 205, wherein binds to a unique binding site on the IL-7Rα subunit that is different from the binding site on the IL-7Rα subunit to which IL-7 binds.

Aspect 208. An IL-7Rαγc ligand, wherein the IL-7Rαγc ligand is selected from a peptide having the amino acid sequence of any one of an amino acid sequence of Formula (6) (SEQ ID NO: 2125), an amino acid sequence of Formula (6a) (SEQ ID NO: 2126), an amino acid sequence of Formula (6b) (SEQ ID NO: 2127), an amino acid sequence of Formula (6c) (SEQ ID NO: 2128), an amino acid sequence of Formula (6d) (SEQ ID NO: 2129), an amino acid sequence of Formula (6e) (SEQ ID NO: 2130), an amino acid sequence of Formula (6f) (SEQ ID NO: 2131), an amino acid sequence of Formula (6g) (SEQ ID NO: 2132), a truncated an amino acid sequence of any one Formula (6)-(6g), an amino acid sequence having greater than 80% sequence similarity to any one of Formula (4)-(6g), or a combination of any of the foregoing:

(6)
-$X^{198}$-$X^{199}$-$X^{200}$-I-P-W-C-T-L-D-P-G-$X^{210}$-L-Q-C-A-W-L-$X^{217}$-$X^{218}$-$X^{219}$-$X^{400}$-VVCQDWEGVELCWQ- (6a)
-$X^{199}$-$X^{200}$-I-P-W-C-T-L-D-P-G-$X^{210}$-L-Q-C-A-W-L-$X^{217}$-$X^{218}$-$X^{219}$-$X^{400}$-VVCQDWEGVELCWQ- (6b)
-$X^{200}$-I-P-W-C-T-L-D-P-G-$X^{210}$-L-Q-C-A-W-L-$X^{217}$-$X^{218}$-$X^{219}$-$X^{400}$-VVCQDWEGVELCWQ- (6c)
-I-P-W-C-T-L-D-P-G-$X^{210}$-L-Q-C-A-W-L-$X^{217}$-$X^{218}$-$X^{219}$-$X^{400}$-VVCQDWEGVELCWQ- (6d)
-$X^{198}$-$X^{199}$-$X^{200}$-I-P-W-C-T-L-D-P-G-$X^{210}$-L-Q-C-A-W-L-$X^{217}$-$X^{218}$-$X^{400}$-VVCQDWEGVELCWQ- (6e)
-$X^{198}$-$X^{199}$-$X^{200}$-I-P-W-C-T-L-D-P-G-$X^{210}$-L-Q-C-A-W-L-$X^{217}$-$X^{400}$-VVCQDWEGVELCWQ- (6f)
-$X^{198}$-$X^{199}$-$X^{200}$-I-P-W-C-T-L-D-P-G-$X^{210}$-L-Q-C-A-W-L-$X^{400}$-VVCQDWEGVELCWQ- (6g)
-$X^{198}$-$X^{199}$-$X^{200}$-I-P-W-C-T-L-D-P-$X^{210}$-L-Q-C-A-W-L-$X^{400}$-VVCQDWEGVELCWQwherein,
$X^{198}$ is selected from A, G, P, S, T, and V;
$X^{199}$ is selected from F, H, W, and Y;
$X^{200}$ is selected from A, G, H, K, P, R, S, and T;
$X^{210}$ is selected form A, G, P, S, and T;
$X^{217}$ is selected from A, G, H, K, P, R, S, and T;
$X^{218}$ is selected from an amino acid and a single bond; and
$X^{219}$ is selected from an amino acid and a single bond; and
$X^{400}$ is selected from $(G)_n$ (SEQ ID NO: 9390), (GS)$_n$ (SEQ ID NO: 9391), (GGS)$_n$ (SEQ ID NO: 9392), (GGGS)$_n$ (SEQ ID NO: 9393), (GGGGS)$_n$ (SEQ ID NO: 9394) or a combination of any of the foregoing, where n is an integer from 1 to 5.

Aspect 209. The IL-7Rαγc ligand of aspect 208,
$X^{198}$ is selected from V and G;
$X^{199}$ is selected from H and W;
$X^{200}$ is selected from R and G;
$X^{210}$ is selected form G and S;
$X^{217}$ is selected from R and G;
$X^{218}$ is selected from Q, G, K and a single bond; and
$X^{219}$ is selected from G, H, M, and a single bond.

Aspect 210. The IL-7Rαγc ligand of any one of aspects 208 to 209, wherein $X^{198}$ is V, $X^{199}$ is H, and $X^{200}$ is R.

Aspect 211. The IL-7Rαγc ligand of any one of aspects 208 to 209, wherein $X^{198}$ is G, $X^{199}$ is W, and $X^{200}$ is G.

Aspect 212. The IL-7Rαγc ligand of any one of aspects 208 to 211, wherein $X^{210}$ is G.

Aspect 213. The IL-7Rαγc ligand of any one of aspects 208 to 211, wherein $X^{210}$ is S.

Aspect 214. The IL-7Rαγc ligand of any one of aspects 208 to 213, wherein $X^{217}$ is R.

Aspect 215. The IL-7Rαγc ligand of any one of aspects 208 to 213, wherein $X^{217}$ is R, $X^{218}$ is Q, and $X^{219}$ is M.

Aspect 216. The IL-7Rαγc ligand of any one of aspects 208 to 213, wherein $X^{217}$ is G, $X^{218}$ is K, and $X^{219}$ is H.

Aspect 217. The IL-7Rαγc ligand of any one of aspects 208 to 216, wherein $X^{400}$ is -GGGGSGG- (SEQ ID NO: 9404).

Aspect 218. The IL-7Rαγc ligand of any one of aspects 208 to 217, wherein the IL-7Rα ligand comprises from 1 to 5 flanking glycines on the the N-terminus and/or the C-terminus.

Aspect 219. The IL-7Rαγc ligand of any one of aspects 208 to 217, wherein the ligand comprises an amino acid sequence or a truncated amino acid sequence selected from any one of SEQ ID NOS: 2125-2132:

Aspect 220. The IL-7Rαγc ligand of any one of aspects 208 to 217, wherein the ligand comprises an amino acid sequence selected from any one of SEQ ID NOS: 2125-2132, or a truncated amino acid sequence of any one of SEQ ID NOS: 2125-2132, wherein the amino acid sequence independently comprises from 1 to 4 glycines (G) (SEQ ID NO: 2045) on the N-terminus, on the C-terminus, or on both the N- and C-termini.

Aspect 221. The IL-7Rαγc ligand of any one of aspects 208 to 217, wherein the ligand comprises an amino acid sequence selected from any one of SEQ ID NOS: 2125-2132, or a truncated amino acid sequence of any one of SEQ ID NOS: 2125-2132, wherein the amino acid sequence comprises one or more amino acid substitutions such as from 1 to 5 amino acid substitutions.

Aspect 222. The IL-7Rαγc ligand of any one of aspects 208 to 217, wherein the ligand comprises an amino acid sequence or a truncated amino acid sequence similarity greater than 60%, greater than 70%, greater than 75%, greater than 80%, greater than 85%, greater than 90%, or greater than 95% to the amino acid sequence of any one of SEQ ID NOS: 2125-2132.

Aspect 223. The IL-7Rαγc ligand of any one of aspects 208 to 222, wherein the ligand binds to the hIL-7Rα subunit with an $IC_{50}$ of less than 10 μM as determined using phage ELISA competition assays.

Aspect 224. The IL-7Rαγc ligand of any one of aspects 208 to 223, wherein binds to a unique binding site on the IL-7Rα subunit that is different from the binding site on the IL-7Rα subunit to which IL-7 binds.

EXAMPLES

The following examples describe in detail methods of synthesizing IL-7Rαγc ligands, methods of synthesizing IL-7Rαγc constructs, and methods of determining the activity of IL-7Rαγc ligands and IL-7Rαγc ligand constructs provided by the present disclosure and the experimental results. The following examples also describe in detail methods for determining properties of the IL-7Rαγc ligands and IL-7Rαγc constructs provided by the present disclosure. It will be apparent to those skilled in the art that many modifications, both to materials and methods, may be practiced without departing from the scope of the invention.

In the examples, the IL-7Rα subunit refers to human IL-7Rα (CD127 protein, Fc Tag) (21-236), Accession No. P16871-1 and was obtained from ACRObiosystems, Inc., product number ILB-H5258. The Rγc subunit refers to human Rγc (CD132 protein, Fc Tag) (23-254), Accession No. AAH14972 and was obtained from ACRObiosystems, Inc., product number ILG-H5256.

Example 1

Chemical Synthesis of IL-7Rα Ligands and Rγc Ligands

2-Cholorotrityl resin (1 g, 1.5 mmole/g, from Anaspec) was washed with DMF (2x), and then allowed to stand in 50 mL DMF for 10 min. The swollen resin was treated with an activated solution of Fmoc-glycine prepared from 5 eq. of amino acid and 5 eq. of HATU dissolved at 0.5M in DMF, followed by the addition of 10 eq. of DIEA, and the mixture gently stirred for 30 min at 25° C. The resin was washed (DMF, THF, DCM, and MeOH) and dried to yield the Fmoc-protected resin. Fmoc groups were then removed by gently shaking the resin with 30% piperidine in DMF for 20 min, followed by washing (DMF, THF, DCM, and MeOH), and drying. The resin was then subjected to repeated cycles of Fmoc-amino acid couplings with HATU activation and Fmoc removal with piperidine to build a desired amino acid sequence. Except for examples with four cysteine residues in the sequence, standard 95% TFA-labile amino acid sidechain protecting groups were used. With compounds with four cysteines, for the two cysteine residues proximal to the resin, Trt protection was used, and for the two cysteine residues distal to the resin, Acm protection was used. After Fmoc removal from the final amino acid of the dimer sequence, in some cases the terminal amine groups were acylated with acetic anhydride (10 eq.) and DIEA (20 eq.) in DMF for 20 min, followed by washing as described above.

The completed peptide was cleaved from the resin by suspension in a solution of TFA (95 vol %), water (2.5 vol %), and triisopropylsilane (2.5 vol %) for 3 h at 25° C. The TFA solution was cooled to 5° C. and poured into $Et_2O$ to precipitate the peptide. Filtration and drying under reduced pressure gave the desired peptide. Purification via preparative HPLC with a C18 column afforded the pure peptide with the two C-terminal thiol groups in a reduced state. This peptide was dissolved in 20% DMSO/water (1 mg dry weight peptide/mL) and allowed to stand at 25° C. for 36 h, and then purified by reverse phase HPLC to provide the peptide with the two C-terminal thiols linked by a disulfide bridge. In compounds containing four cysteines, the two N-terminal Acm-protected cysteine residues were then deprotected by dissolving 0.1 mmole of peptide in 25 mL of 50% acetic acid/$H_2O$ and 2.5 mL of 1M HCl and adding 5 mL of 0.1M iodine (in glacial acetic acid; 5 eq.) dropwise with stirring under a nitrogen atmosphere. The deprotection/oxidation reaction was allowed to proceed for 2 h at 25° C. with frequent monitoring (analytical HPLC) to ensure complete reaction. The reaction was stopped by addition of ice-cooled diethyl ether (9 volume eq.). The resulting solution was cooled on dry ice (3 min), the ether solution carefully decanted, and the resulting light-yellow solid purified by preparative reverse phase HPLC (95%) to yield the final peptide dimer having an IL-7Rα and an Rγc ligand.

Example 2

Synthesis of IL-7Rαγc Ligands Using Click Chemistry

The peptide sequences of IL-7Rα ligand and Rγc ligands were synthesized separately using standard solid phase synthesis conditions and Fmoc-protected amino acids as described in Example 1.

Rink amide-MBHA resin (1 g, 1.5 mmole/g, Anaspec) was washed with DMF (2x), and then allowed to stand in 50 mL DMF for 10 min. Separate portions of the swollen resin were treated with either an activated solution of Fmoc-propargyl glycine (IL-7Rα ligand) or 2-(Fmoc-NH)-5-azido-pentanoic acid (Rγc ligand) prepared from 5 eq. of amino acid and 5 eq. of HATU dissolved at 0.5M in DMF, followed by the addition of 10 eq. of DIEA, and the mixture was gently stirred for 30 min at 25° C. The resin was washed (DMF, THF, DCM, and MeOH) and dried to yield the Fmoc-protected resin. Fmoc groups were then removed by gently shaking the resin in 30% piperidine in DMF for 20 min, followed by washing (DMF, THF, DCM, and MeOH), and drying. The resin was then subjected to repeated cycles of Fmoc-amino acid couplings with HATU activation and Fmoc removal with piperidine to provide a desired Rγc ligand amino acid sequence and a desired IL-7Rα ligand amino acid sequence. Standard 95% TFA-labile amino acid sidechain protecting groups were used for all residues. After Fmoc removal from the final amino acid of each ligand sequence, the terminal amine groups were acylated with acetic anhydride (10 eq.) and DIEA (20 eq.) in DMF for 20 min.

Each completed ligand was cleaved from the resin by suspension in a solution of TFA (95%), water (2.5%), and triisopropylsilane (2.5%) for 3 h at 25° C. The TFA solution was cooled to 5° C. and poured into $Et_2O$ to precipitate the peptide. Filtration and drying under reduced pressure gave the desired ligands. Purification via preparative HPLC with a C18 column afforded the pure peptides with the two thiol groups in a reduced state. The ligands were separately dissolved in 20% DMSO/water (1 mg dry weight peptide/mL), allowed to stand at 25° C. for 36 h, and then purified by reverse phase HPLC to provide the IL-7Rα and Rγc ligands with the two thiols linked via an intramolecular disulfide bridge.

Two-tenths (0.2) mL of a 2.0 mM solution of purified alkyne-containing IL-7Rα ligand was prepared by dissolving the ligand in 1:1 $H_2O$/tBuOH. Similarly, 0.2 mL of a 2.4 mM solution of the purified azide-containing ligand was prepared using the same solvent. The two ligand solutions along with 0.1 mL of 100 mM $CuSO_4$ in $H_2O$, 0.1 mL of 250 mM of a Cu(I) chelating agent such as DIEPA, pyridine, or THPTA (tris(3-hydroxypropyltriazolylmethyl)amine), in 3:1 DMSO/tBuOH, 0.1 mL of 0.5 M ascorbic acid in $H_2O$, and 0.3 mL of 3:2 tBuOH/$H_2O$ were combined, and the reaction allowed to proceed at 45° C. under anaerobic conditions. Reaction progress was monitored frequently by LC/MS, and additional azide-containing ligand and $CuSO_4$ were added to drive the reaction to completion. After the maximal amount of alkyne was consumed (approx. 3 h), the reaction was quenched by addition of approx. 8 mL of 1:1 $H_2O$/ACN, and the peptide dimer purified (95%) using a preparative-scale C18 HPLC column.

The structures of synthetic heterodimers comprising an IL-7Rα ligand and an Rγc ligand are shown in FIGS. 13A and 13B. The structures of the termini of the IL-7Rα and Rγc ligands and the structure of the linkers for the heterodimers is shown in Tables 1-3. Refer to Tables 1-3 for the structures of the linkers, the alkynyl terminal groups, and the azide terminal groups. The SEQ ID NOS: refer to the amino acid sequence without the flanking amino acids.

Example 3

STAT5 Phosphorylation in TF-1-7α Cells with IL-7Rαγc Ligands Having Different Ligand Attachment Orientations IL-7Rαγc ligands were evaluated for induction of STAT5 phosphorylation in TF-1-7α cells. TF-1-7α cells were derived from the growth factor-dependent human erythroleukemia cell line TF-1 (ATCC #CRL-2003), which naturally express common γc receptors (Rγc) but not IL-7Rα. The cells were engineered to be IL-7 responsive by transfection with human full-length IL-7Rα. A cell line expressing higher levels of IL-7Rα was selected by growth in IL-7, and both IL-7Rα and Rγc subunit expression levels were verified by qPCR analysis.

To test compounds for induction of STAT5 phosphorylation TF-1-7α cells were starved overnight at $5 \times 10^5$ cells/mL in starvation medium (RPMI 1640+2.5 g/L glucose+5% FBS+2 mM L-glutamine+1 mM NaPyr+10 mM HEPES with no GM-CSF or rhIL-7 supplement) in T75 flasks. The following day, cells were plated in 96-well V-bottom plates at $2 \times 10^5$ cells/well. Three-fold serial dilutions of IL-7Rα/Rγc ligands or IL-7 in starvation media were added to the cells and incubated for 30 min at 37° C. Cell extracts were prepared by adding a mixture of 10× Cell Lysis Buffer (Cell Signaling Technology #9803) and 1×HALT Phosphatase and Protease Inhibitor Cocktail (Thermo Fisher #78442) directly to the wells. The plates were agitated at 25° C. for 5 min to prepare cell extracts for immediate use or stored at −80° C. Detection of pSTAT5 was performed using a PathScan® Phospho-Stat5 (Tyr694) Sandwich ELISA Kit (Cell Signaling Technology #7113). Cell extracts were added to microwells that were pre-coated with a mouse anti-phospho-STAT5 antibody and incubated overnight at 4° C. Wells were then washed with PBS and bound phospho-STAT5 (Tyr694) was detected by adding a rabbit anti-STAT5 detection antibody and incubating for 1 h at 37° C. Wells were washed with PBS and an anti-rabbit IgG HRP-linked antibody was added to each well. After a final wash TMB substrate solution was added to measure the amount of HRP in each well. Absorbance at 450 nm was read in a microplate reader. The signal that was produced is proportional to the quantity of phosphorylated STAT5 in each cell extract.

Figure 2:
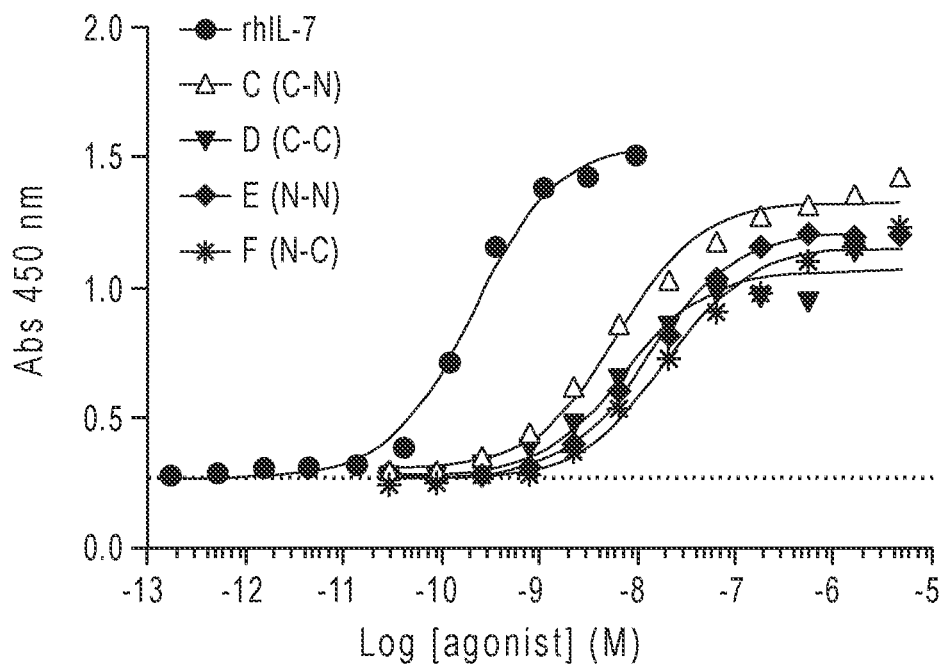
FIG. 2 shows STAT5 phosphorylation in TF-1-7α cells exposed to rhIL-7 or to IL-7Rαγc ligands having various attachment orientations of the respective IL-7Rα ligand and Rγc ligand.

The results are presented in FIG. 2. The structures of the IL-7Rαγc ligands evaluated in FIG. 2 are provided in FIGS. 13A-13B.

Example 4

Recombinant Fusion Proteins Incorporating an IL-7Rαγc Ligand

Mammalian expression vectors were constructed to express IL-7Rαγc ligands linked to full-length human IgG, or to Fc-fragments consisting of the CH2 and CH3 domains of the heavy chain and hinge regions of human IgG2. Each vector included strong constitutive promoter (CMV or hEF1-HTLV) and an IL-2 signal peptide sequence for secretion of the fusion protein into the culture media. Vectors were designed to enable peptide ligands to be fused to either the N- or C-terminus of the immunoglobulin proteins and to incorporate construct linkers of varying lengths between the IL-7Rαγc ligands and IgG. Fusion proteins were transiently expressed in 293 human embryonic kidney cells (FreeStyle® 293-F) by transfecting plasmid DNA into the cells using polyethyleneimine reagent PEI MAX (Polysciences, Inc.). Transfected cells were grown in FreeStyle® 293 Expression Medium (ThermoFisher) in shaker flasks in a 37° C. humidified $CO_2$ incubator on an orbital shaker rotating at 125 rpm. Cultures were harvested 96 h post-transfection by centrifugation and the secreted fusion proteins were purified from the supernatants using protein A affinity chromatography.

Protein A agarose resin was mixed with culture supernatant and incubated at room temperature for several hours. The resin was then washed three times with PBS and bound IgG IL-7Rα/Rγc ligand fusion was eluted with 0.1 M glycine buffer (pH 2.8). Eluates were neutralized with 1M Tris buffer and quantified by measuring absorbance at 280 nm using a NanoDrop® spectrophotometer. Protein concentrations were determined using calculated extinction coefficients derived from the primary sequence of the protein. Size exclusion chromatography was used to remove high molecular weight impurities prior to measuring the activities of the fusion proteins in bioassays.

The amino acid sequences of the IL-7Rαγc ligand fusion proteins used in the experimental examples are provided in FIGS. 14A-14D and in FIGS. 17A-17D. The hIgG2 Fc-fragment refers to the Fc region consisting of the CH2 and CH3 domains of the IgG2 heavy chain and the hinge region. The first and second cysteines of the hinge region were replaced with serine to prevent detrimental disulfide bridges. The last amino acid (lysine) of the Fc region was replaced with an alanine for fusion stability. The N-terminus of IgG2 Fc-fusion constructs may include Ala-Pro-Leu (derived from InvivoGen vector).

Example 5

Figure 3:
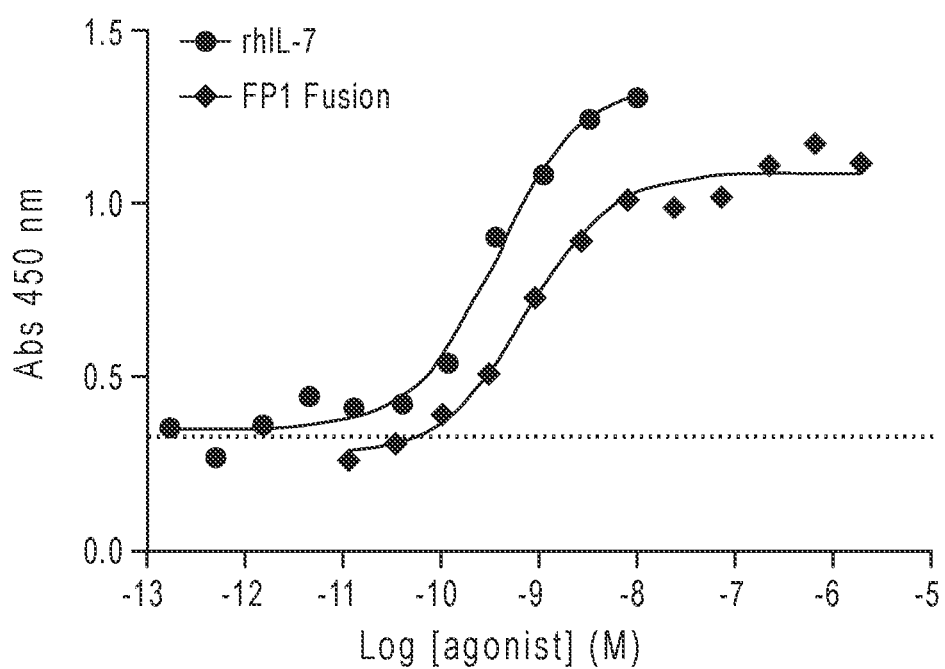
FIG. 3 shows STAT5 phosphorylation in TF-1-7α cells exposed to rhIL-7 and to an Fc-IL-7Rαγc ligand fusion construct.
Figure 4:
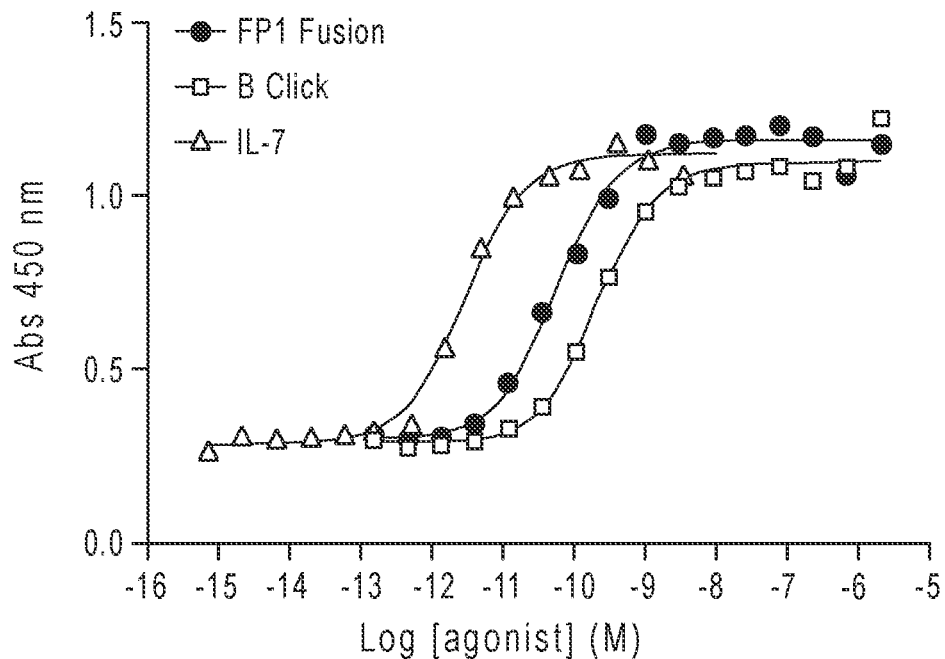
FIG. 4 shows STAT5 phosphorylation in resting human PBMC cells exposed to rhIL-7, a synthetic IL-7Rαγc ligand, or an Fc-IL-7Rαγc ligand fusion construct.
Figure 18:
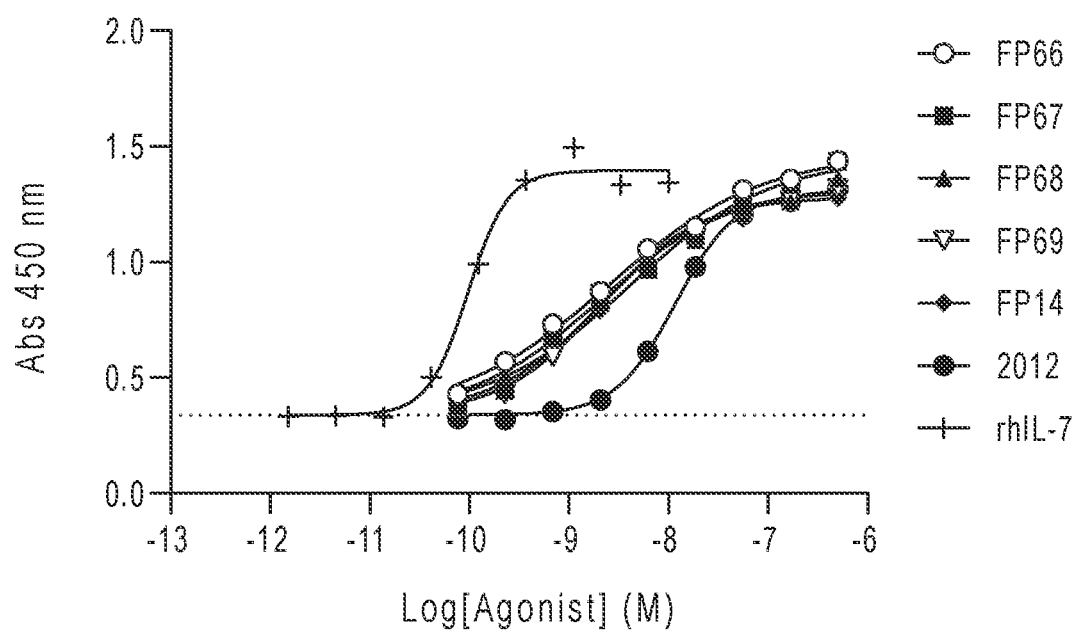
FIG. 18 shows STAT5 phosphorylation in TF-1-7α cells for rhIL-7 and for various Fc-IL-7Rαγc ligand fusion constructs.
Figure 19:
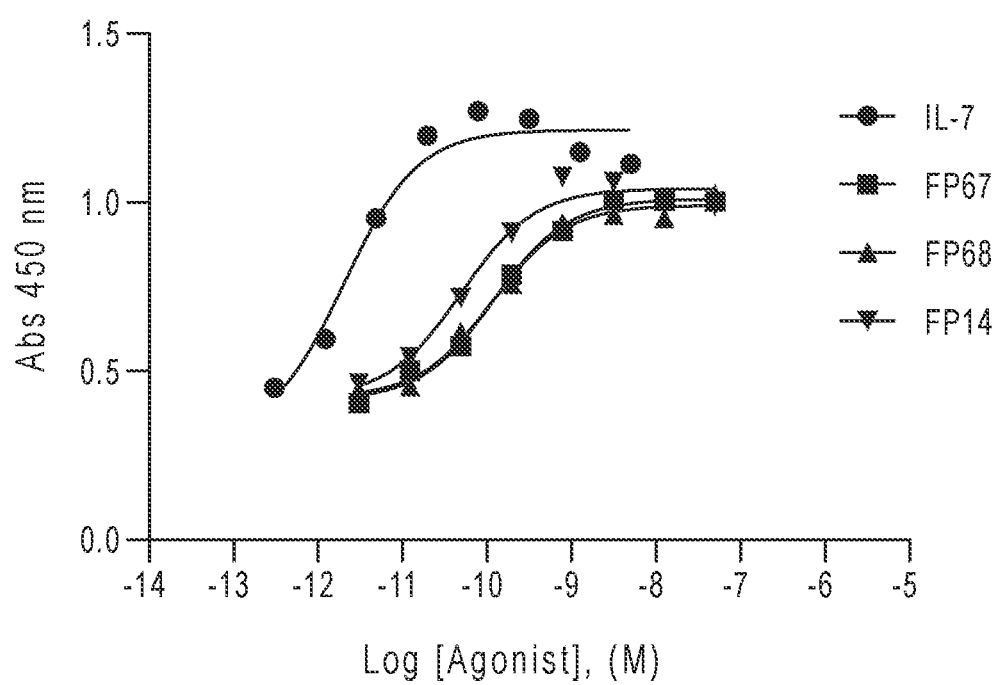
FIG. 19 shows STAT5 phosphorylation in activated Cyno PBMCs for various Fc-IL-7Rαγc ligand fusion constructs.
Figure 22:
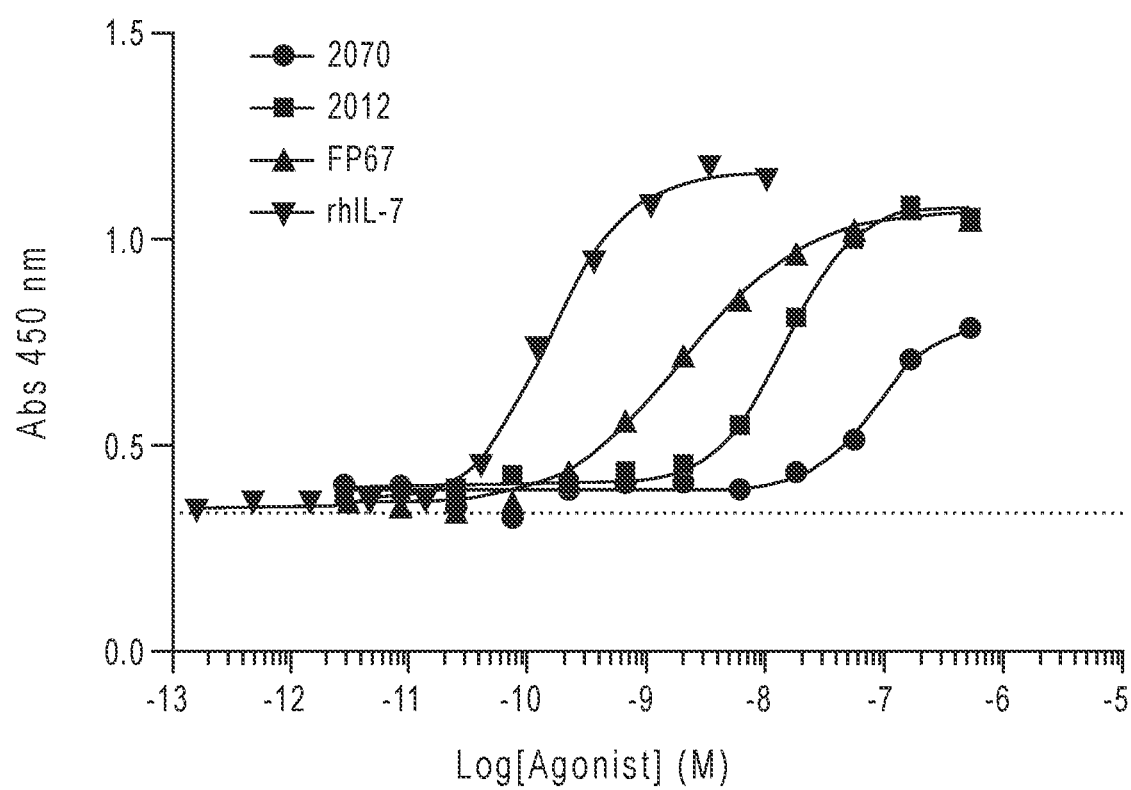
FIG. 22 shows STAT5 phosphorylation in TF-1-7α cells for rhIL-7, for IL-7Rαγc ligands, and for various Fc-IL-7Rαγc ligand fusion constructs.

STAT5 Phosphorylation in TF-1 7α Cells and Human/Cynomolgus Monkey PBMCs with IL-7Rαγc Ligands The agonist activity of IL-7Rαγc ligands comprising synthetic peptide heterodimers and Fc-fusion proteins was evaluated in STAT5 phosphorylation assays in TF-1 7Rα cells, and primary human and cynomolgus monkey peripheral blood mononuclear cells (PBMCs). Compounds were incubated with cells and STAT5 phosphorylation was measured as a function of concentration using the methods described in Example 3. Results from STAT5 phosphorylation assays in TF-1 7Rα cells are presented in FIGS. 3, 18, and 22. The results from STAT5 phoSphorylation assays in human PBMCs are shown in FIG. 4, and for activated cynomolgus monkey PBMCs in FIG. 19.

The structures of the IL-7Rαγc ligand and IL-7Rαγc fusion construct evaluated in FIGS. 3, 4, 18, 19 and 22 are provided in FIGS. 13, 14, 17 and Table 4.

Example 6

Proliferation of CD4+ and CD8+ Cells from Human PBMCs with IL-7Rαγc Ligands

Human PBMCs were isolated from a buffy coat by density gradient centrifugation (Lymphoprep®, Stemcell Technologies #07811) and cultured overnight in T-cell medium (CTS OpTmizer®, ThermoFisher #A1048501) at $3 \times 10^6$ cells/mL in a T75 flask. The following day, cells were resuspended in fresh medium and plated at $5 \times 10^5$ cells/well in a 96-well cell culture plate. Three-fold serial dilutions of either IL-7 or an IL-7Rα ligand were added to the cells and incubated for 4 days at 37° C. After the treatment, cells were incubated in viability dye (Live/Dead® Fixable Aqua Cell Stain Kit, ThermoFisher #L34965) for 30 min at 37° C., after which surface antibody staining was then performed in PBS+2% FBS for 30 min on ice. Cells were fixed and permeabilized with Fixation/Permeabilization Buffer (eBioscience Foxp3/Transcription Staining Buffer Set, ThermoFisher #00-5523-00) for 30 min on ice. Intracellular (Ki-67) staining was performed in Permeabilization Buffer for 30 min on ice and the treated cells resuspended in PBS+2% FBS prior to FACS analysis. The CD4 and CD8 T-cell populations were identified as CD3+CD4+CD8− and CD3+CD8+CD4− respectively.

Antibody conjugates used for cell surface and intracellular staining are shown in Table 5.

TABLE 5

Antibody conjugates used for cell surface and intracellular staining.

| Marker | CD159a | CD25 | CD3 | CD56 | Ki-67 | Live/Dead | CD4 | CD8 | Foxp3 |
|---|---|---|---|---|---|---|---|---|---|
| Fluor | APC | AF780 | AF488 | PerCP-eFl710 | BV421 | Aqua | BV650 | BUV737 | PE |
| Clone | Z199 | CD25-4E3 | SP34 | CMSSB | B56 | — | L200 | SK1 | 206D |
| Vendor | Beckman Coulter | Invitrogen | BD | Invitrogen | BD | Invitrogen | BD | BD | BioLegend |
| Cat. No. | A607797 | 47-0257-42 | 557705 | 46-0567-42 | 562899 | L34957 | 563737 | 612754 | 320108 |

Figure 5:
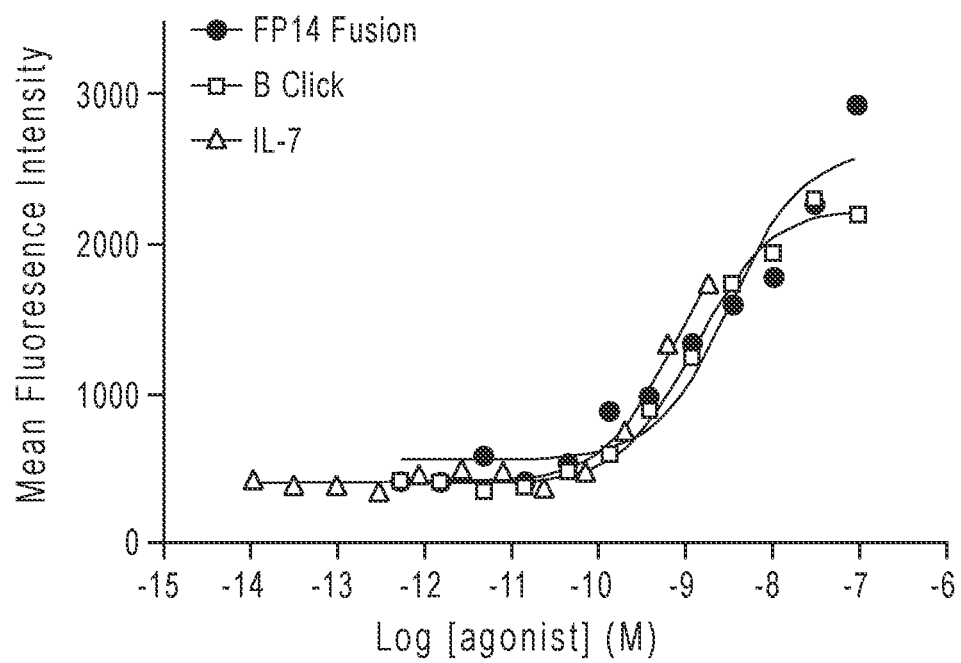
FIG. 5 shows proliferation of human CD-8+ T-cells following exposure to rhIL-7, a synthetic IL-7Rαγc ligand, or an Fc-IL-7Rαγc ligand fusion construct measured by Ki-67 median fluorescence intensity.
Figure 6:
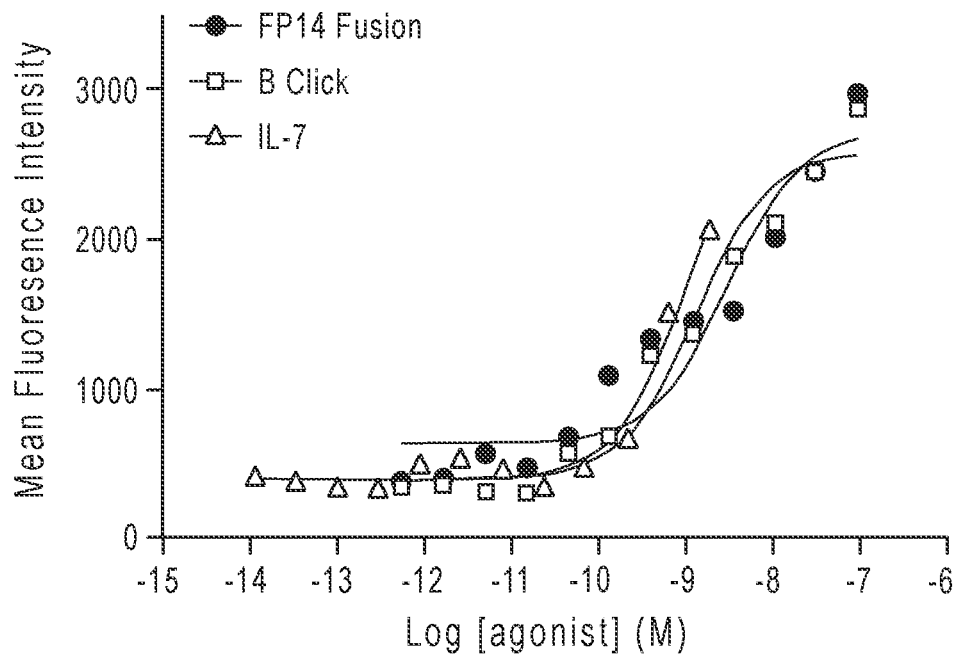
FIG. 6 shows proliferation of human CD-4+ T-cells following exposure to rhIL-7, a synthetic IL-7Rαγc ligand, or an Fc-IL-7Rαγc ligand fusion construct measured by Ki-67 median fluorescence intensity.

IL-7Rαγc ligand B (FIG. 13A) and the hIgG2-Fc IL-7Rα/Rγc ligand fusion protein having SEQ ID NO: 1212 (FIG. 14A) exhibited an $EC_{50}$ equivalent to IL-7 as determined using the Ki-67 proliferation assay in CD8+CD4 and CD4+CD8 T-cells. The results are presented in FIGS. 5 and 6, respectively. The structures of the IL-7Rαγc ligand and the IL-7Rαγc fusion construct are provided in FIGS. 13A-13B and 14A-14D.

Example 7

Peptide Truncations

The impact of C-terminal and N-terminal amino acid truncations of the IL-7Rα ligand having SEQ ID NO: 454 on binding to the IL-7Rα subunit was investigated.

Truncated IL-7Rα ligand sequences were synthesized using standard solid phase synthesis conditions and Fmoc-protected amino acids as described in Example 1. A series of peptides were synthesized with Gly-Gly (SEQ ID NO: 9399), Met-Gly-Gly, Gln-Met-Gly-Gly (SEQ ID NO: 9431), or Arg-Gln-Met-Gly-Gly (SEQ ID NO: 9432) omitted from the C-terminus and Val, Val-His, Val-His-Arg, or -Val-His-Arg-Ile (SEQ ID NO: 9433) omitted from the N-terminus of the IL-7Rα ligand having SEQ ID NO: 454. The amino acid sequences of the truncated IL-7Rα ligands are shown in Table 6.

TABLE 6

Truncated IL-7Rα ligands based on SEQ ID NOS: 407, 454, 457-458, 487-494, 496, and 514.

```
SEQ ID NO: 407  V H R I P W C T L D P G G L Q C A W L R Q M
SEQ ID NO: 454  V H R I P W C T L D P G G L Q C A W L R Q M G G
SEQ ID NO: 457  V H R I P W C T L D P G G L Q C A W L R Q
SEQ ID NO: 458  V H R I P W C T L D P G G L Q C A W L R
SEQ ID NO: 514  V H R I P W C T L D P G G L Q C A W L
SEQ ID NO: 487  V H R I P W C T L D P G G L Q C A W
SEQ ID NO: 488  V H R I P W C T L D P G G L Q C A
SEQ ID NO: 489  V H R I P W C T L D P G G L Q C
SEQ ID NO: 454  V H R I P W C T L D P G G L Q C A W L R Q M G G
SEQ ID NO: 490    H R I P W C T L D P G G L Q C A W L R Q M G G
SEQ ID NO: 491      R I P W C T L D P G G L Q C A W L R Q M G G
SEQ ID NO: 492        I P W C T L D P G G L Q C A W L R Q M G G
SEQ ID NO: 493          P W C T L D P G G L Q C A W L R Q M G G
SEQ ID NO: 494            W C T L D P G G L Q C A W L R Q M G G
SEQ ID NO: 496              C T L D P G G L Q C A W L R Q M G G
```

Binding of the synthetic IL-7Rα peptide ligands to IL-7Rα was evaluated using a competition binding ELISA. Microtiter plate wells were coated with IL-7Rα-Fc (CD127 protein, Fc tag; ECD 21-236; ACRObiosystems, Inc, Cat. #ILA-H5258) at 1 µg/mL; 50 µL per well in PBS for at least 1 h. The plate was washed once with wash buffer (200 µL, PBS containing 0.05% Tween®-20 (Sigma). Wells were blocked with blocking buffer (PBS containing 1% BSA (BSA Fraction V; VWR Cat. #97061-416) for 1 h. A serial dilution of peptides was prepared, at twice the final concentration, in assay buffer (PBS containing 0.5% BSA and 0.05% Tween®-20) in a 96-well polypropylene plate. A terminal biotinylated form of the reference IL-7Rα peptide ligand having SEQ ID NO: 454 was used to make a precomplex with NeutrAvidin-HRP (NA-HRP; ThermoFisher Cat. #31030) (Precomplex referred to as bnPeptide::NA-HRP). The bnPeptide::NA-HRP precomplex was prepared by mixing 1.5 µL 100 µM biotinylated peptide, 2

μL NA-HRP and 11.5 PBS and incubated at 4° C. for at least 45 min. After blocking the wells, the plate was washed with a plate washer and serial dilutions of the peptides were added (50 μL/well) and the plate was incubated at 4° C. for 1 h on a plate shaker. The bnPeptide:NA-HRP precomplex was diluted to 40 nM and, without washing, 50 μL was added to each assay well. The plate was returned to 4° C. and incubated for 45 min. The plate was washed using the plate washer and cold wash buffer. Fifty (50) μL of TMB One Component HRP Microwell substrate (TMB; Surmodics Cat. #TMBW-1000-01) was then added to each well, and the wells were incubated for 1-10 min at 25° C. Fifty (50) μL of a solution (Surmodics Cat. #LSTP-0100-0) was then added and the plate read at 450 nm.

The results are shown in FIGS. 7 and 8.

Example 8

Alanine Scan

A series of peptides were synthesized where each amino acid residue between the two cysteines was systematically replaced by an alanine residue (Ala-scan). The peptide sequences were synthesized using standard solid phase synthesis conditions and Fmoc-protected amino acids as described in Example 1. The interaction of the Ala-scan peptides with IL-7Rα was evaluated using a competition binding assay as described in Example 7.

The peptide sequences are provided in Table 7 and the results are presented in Table 8.

The peptide sequences (SEQ ID NOS: 1031-1039) are provided in Table 7 and the results are presented in Table 8.

TABLE 7

Amino acid sequences for alanine scan.

| | |
|---|---|
| SEQ ID NO: 1031 | G G V V C Q D W E G V E L C W Q G G |
| SEQ ID NO: 1032 | G G V V C A D W E G V E L C W Q G G |
| SEQ ID NO: 1033 | G G V V C Q A W E G V E L C W Q G G |
| SEQ ID NO: 1034 | G G V V C Q D A E G V E L C W Q G G |
| SEQ ID NO: 1035 | G G V V C Q D W A G V E L C W Q G G |
| SEQ ID NO: 1036 | G G V V C Q D W E A V E L C W Q G G |
| SEQ ID NO: 1037 | G G V V C Q D W E G A E L C W Q G G |
| SEQ ID NO: 1038 | G G V V C Q D W E G V A L C W Q G G |
| SEQ ID NO: 1039 | G G V V C Q D W E G V E A C W Q G G |

TABLE 8

Binding to Rγc subunit.

| Rγc Ligand | IC$_{50}$ (nM) |
|---|---|
| SEQ ID NO: 1031 | <50 |
| SEQ ID NO: 1032 | <100 |
| SEQ ID NO: 1033 | <50 |
| SEQ ID NO: 1034 | <2000 |
| SEQ ID NO: 1035 | <50 |
| SEQ ID NO: 1036 | <100 |
| SEQ ID NO: 1037 | <2000 |
| SEQ ID NO: 1038 | <50 |
| SEQ ID NO: 1039 | <5000 |

Example 9

Binding Assay with Different IL-7Rα Ligands

A competition binding assay was used to characterize the IL-7Rα binding site of an IL-7Rα ligand having SEQ ID NO: 454 and an IL-7Rα ligand having SEQ ID NO: 402. The competition binding ELISA is described in Example 7. In this example, bnPeptide::NA-HRP precomplexes were made using C-terminal biotinylated forms of the IL-7Rα ligands having SEQ ID NO: 454 and SEQ ID NO: 402.

Figure 9:
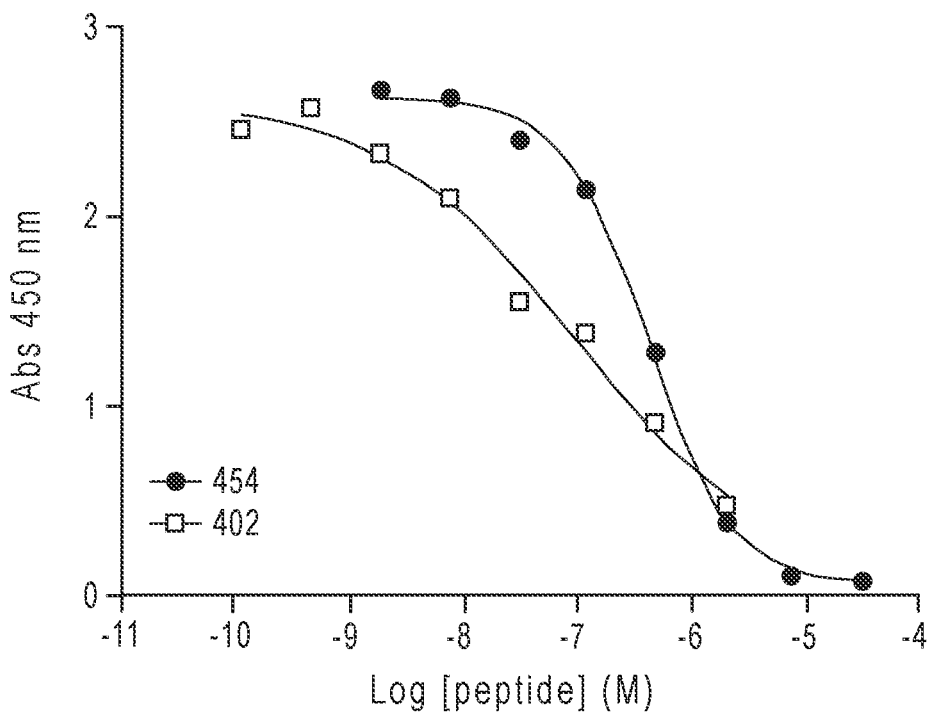
FIG. 9 shows the normalized ELISA signal for competitive binding of an Fc-IL-7Rα ligand fusion construct based on an IL-7Rα having SEQ ID NO: 402 or SEQ ID NO. 407 with corresponding biotinylated/NA-HRP complex.
Figure 10:
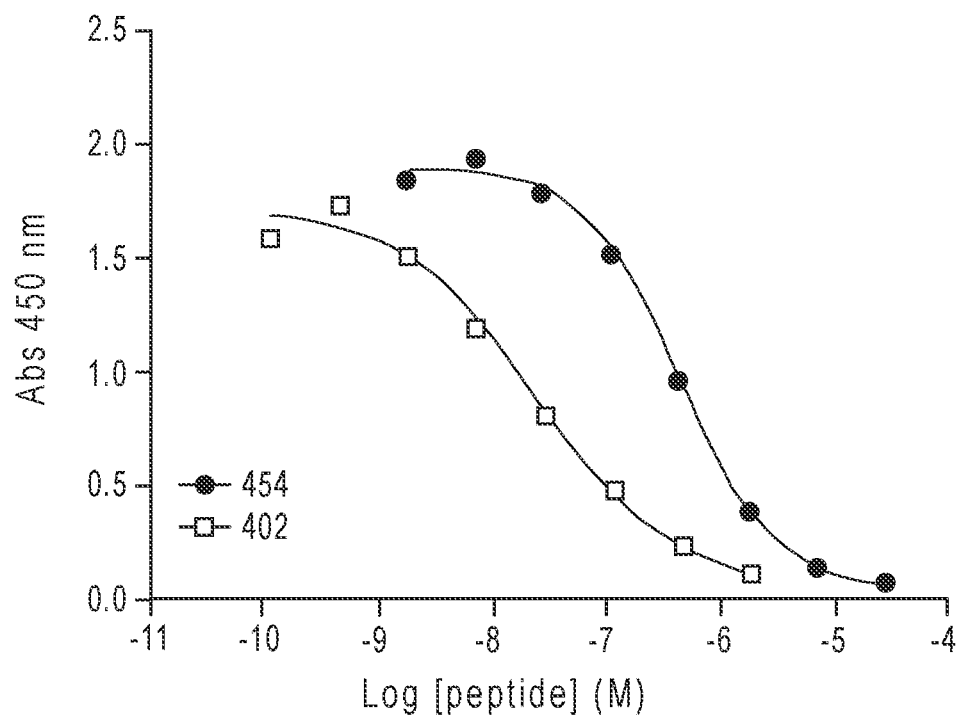
FIG. 10 shows the normalized ELISA signal for competitive binding of various -IL-7Rα ligands having SEQ ID NO: 402 or SEQ ID NO. 454 to the IL-7Rα subunit corresponding to SEQ ID NO: 402.

The results presented in FIG. 9 (bnPeptide::NA-HRP SEQ ID NO: 454) and FIG. 10 (bnPeptide::NA-HRP SEQ ID NO: 402) show that the IL-7Rα ligands tested compete with one another and therefore bind to the same functional site on IL7Rα.

Example 10

IL-7Rαγc Ligand Construct PK Analysis in CD-1 Mice

A pharmacokinetic study of an IL-7Rαγc ligand construct was performed in CD-1 male mice. IL-7Rαγc ligand construct (FP14) was administered intravenously with a single dose of 1 mg/kg into each mouse (n=10). Blood samples were collected at 0 h (pre-dose), 1, 2, 6, 24, 48, 72 and 96 h post compound administration into serum separator vials. Samples were centrifuged at 10,000×g for 5 min at 4° C. followed by transferring the serum to a new tube. Samples were frozen and stored at −80° C. prior to testing.

The TF-1 7Rα STAT5 phosphorylation bioassay was used to quantity the amount of (FP14) present in each of the serum samples. Three-fold serial dilutions of each serum sample or a compound reference standard in starvation media were added to the cells and incubated for 30 mins with the cells. Cells extracts were prepared and the quantity of phosphorylated STAT5 was determined as described in Example 3. The (FP14) concentration in each serum sample was calculated using a standard curve generated from the reference standard.

Figure 11:
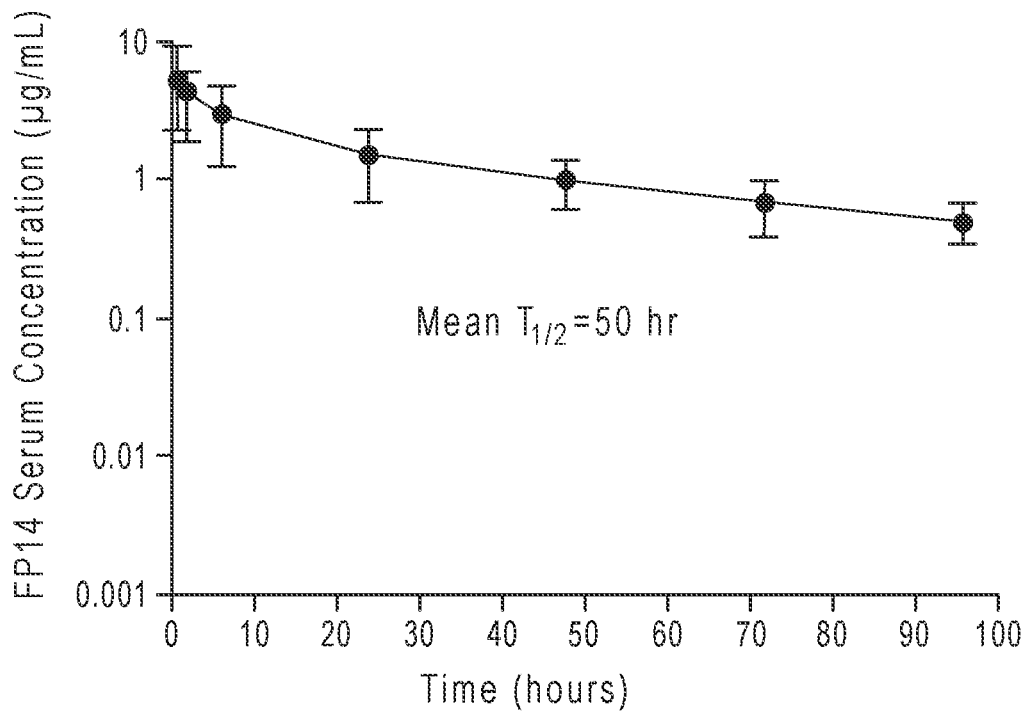
FIG. 11 shows a PK profile of an Fc-IL-7Rαγc ligand fusion construct (FP14, SEQ ID NO: 1225) following administration to mice.

The results are presented in FIG. 11.

Example 11

IL-7Rαγc Ligand Pembrolizumab Fusion Protein

An IL-7Rαγc ligand was fused to the C-terminus of the heavy chain of a therapeutic checkpoint inhibitor antibody that targets PD-1 (Pembrolizumab (FP8) (SEQ ID NO: 1219) as described in Example 4. The construct was transiently co-expressed with the corresponding light chain construct (SEQ ID NO: 1218) in HEK-293F cells to produce the full IgG IL-7Rα/Rγc ligand fusion protein.

Figure 12:
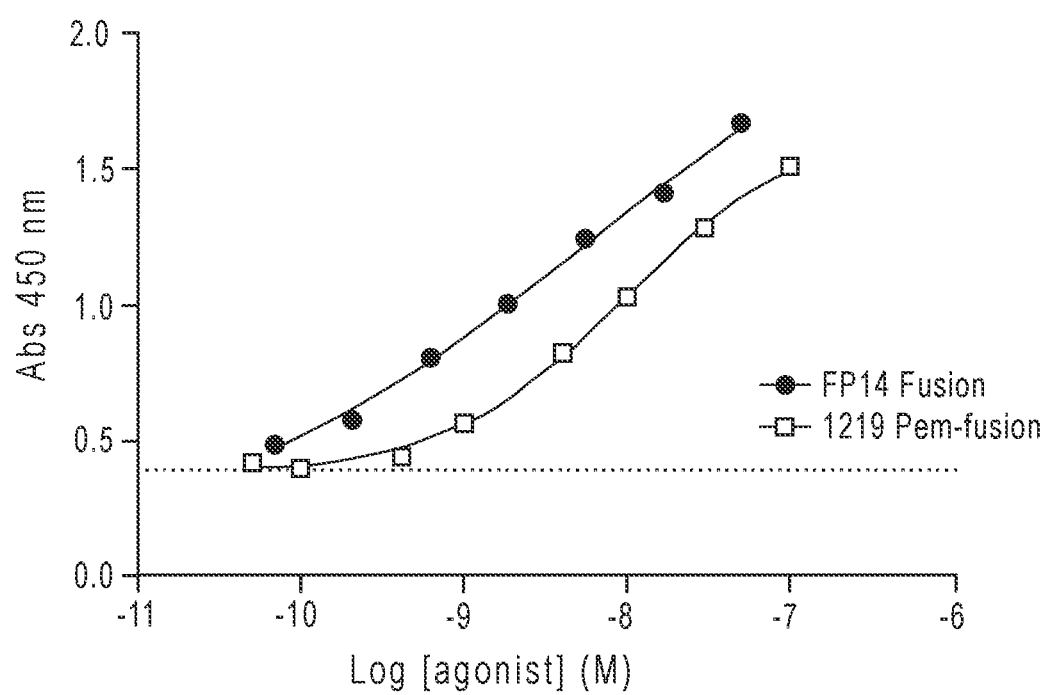
FIG. 12 shows STAT5 phosphorylation in TF-1-7α cells exposed to an Fc-IL-7Rαγc ligand fusion protein (FIG. 14B; SEQ ID NO: 1225), or to an IL-7Rαγc ligand-anti-PD-1 antibody fusion (FIG. 14B; SEQ ID NO: 1219).
Figure 15A:
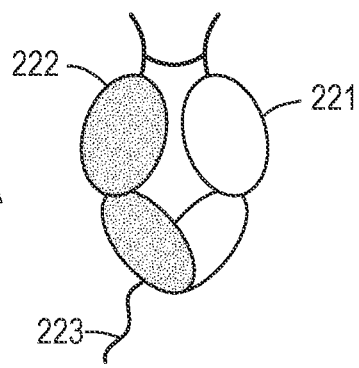
FIGS. 15A-15F show examples of various configurations of IL-7Rαγc ligand Fc-fragment fusion proteins provided by the present disclosure.
Figure 15B:
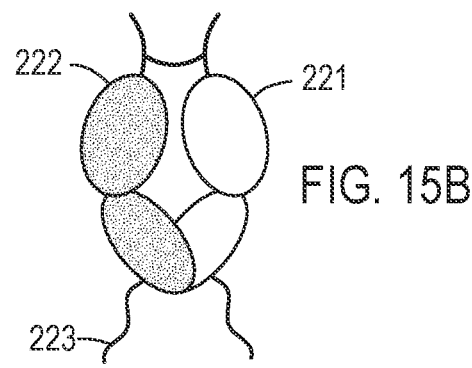
Figure 15C:
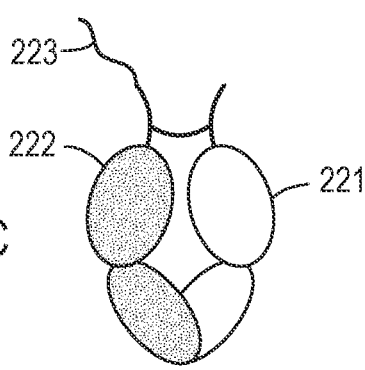
Figure 15D:
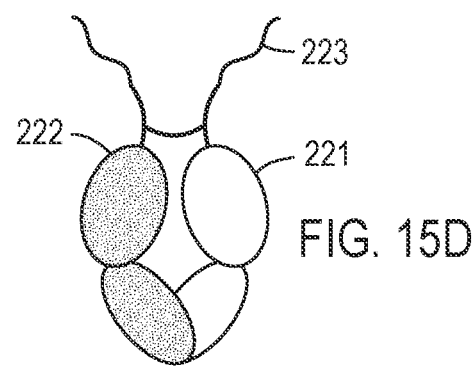
Figure 15E:
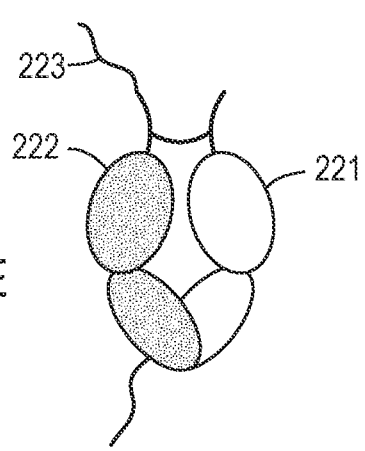
Figure 15F:
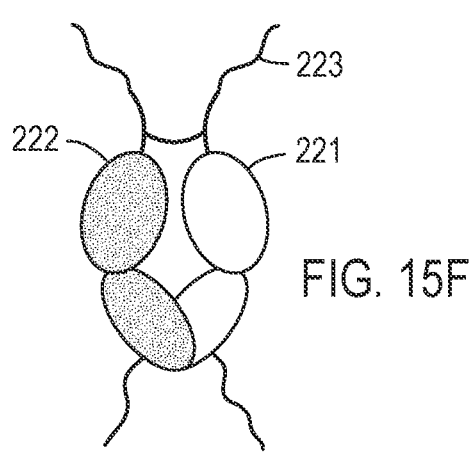

Agonist activity of Pembrolizumab IL-7Rαγc ligand fusion protein was measured in a STAT5 phosphorylation assay with TF-1 7Rα cells using the methods described in Example 3. Results are shown in in FIG. 12. The structure of the Pembrolizumab IL-7Rαγc ligand fusion protein is provided in FIG. 14B. The structure of the IL-7Rαγc fusion protein is shown in FIG. 14B.

Example 12

Unique IL-7Rα Binding Site

Competitive binding assays were performed to characterize the binding site for IL-7Rα ligands on the IL-7Rα subunit.

Representative phage clones displaying peptides from certain IL-7Rα ligand families were bound to the extracellular domain (ECD) of the IL-7Rα subunit immobilized in microtiter wells. Phage binding was conducted in the presence and absence of synthetic test peptides to determine whether the phage-displayed peptides and the test peptides competed for binding to the same site on the IL-7Rα subunit. Synthetic test peptides were selected to represent IL-7Rα ligands from different IL-7Rα ligand families, as well as to provide positive and negative control peptides.

The IL-7Rα ligand families and the specific IL-7Rα ligands within those families that were evaluated are provided in Table 9.

TABLE 9

IL-7Rα ligand families and specific IL-7Rα ligands.

| IL-7Rα Ligand Family | Specific IL-7Rα SEQ ID NO: | Peptide Sequence |
|---|---|---|
| 1 | 146 | Q C V H W D L D T L F G C I R E Q L E L |
| 1 | 5 | Q C I H W D I E T L L S C V |
| 2 | 313 | G G V P W C T L D P G S L Q C A W F |
| 3A | 43 | V Y C A E I G E Y R V C R Q |
| 3B | 104 | Y M A C S S G L S L C R L S |
| N/A | 965 | V V C Q D W E G V E L C W Q |

The IL-7Rα ligands can have a binding affinity ($IC_{50}$) to the hIL-7Rα subunit of less than 10 µM and a binding affinity ($IC_{50}$) to an irrelevant cytokine receptor such as the Rγc subunit of greater than 100 µM.

Phage binding to the immobilized IL-7Rα ECD was detected with an antibody against phage coat proteins (anti-phage antibody HRP conjugate) followed by addition of TMB substrate solution and quantified by measuring absorbance in a microtiter plate reader.

The ELISA signal for each phage binding in the presence and absence of the test peptides was compared to determine which synthetic peptides competed with which phage-displayed peptides for binding to the IL-7Rα subunit. The peptide pairs that exhibited competitive binding (i.e., cross inhibition) were considered to bind at the same functional site on the IL-7 receptor. The results are presented in Table 10.

TABLE 10

Competition for IL-7Rα binding to the IL-7Rα subunit among sequence families of IL-7Rα ligands.

| | IL-7Rα Ligand SEQ ID NO: | Phage Clone SEQ ID NO: | | | | |
|---|---|---|---|---|---|---|
| IL-7Rα Ligand SEQ ID NO: | IL-7Rα Ligand Family | 5<br>1 | 313<br>2 | 43<br>3A | 104<br>3B | 965<br>N/A |
| 146 | 1 | +[1] | + | + | + | 0[2] |
| 5 | 1 | + | + | + | + | –[3] |
| 313 | 2 | + | + | + | + | – |
| 43 | 3A | + | + | + | + | – |
| 104 | 3B | + | + | + | + | – |
| 965[4] | N/A | 0 | 0 | 0 | 0 | 0 |

[1]IL-7Rα ligand competes with phage binding.
[2]IL-7Rα ligand does not compete with phage binding.
[3]Not tested.
[4]Negative control.

The IL-7Rα ligands did not bind competitively to the binding site of the IL-7Rα subunit with IL-7.

Table 10 shows that IL-7Rα ligands representing ligand Families 1, 2, 3A, and 3B compete among themselves for binding to the hIL-7Rα subunit and therefore bind at or near the same site on the hIL-7Rα subunit.

Example 13

Unique Rγc Binding Site

Competitive binding assays were performed to characterize the IL-2Rγc binding site for Rγc ligands, and to IL-7Rαγc ligands.

For Rγc ligands, representative phage clones displaying peptides from IL-2Rγc ligand families were bound to the extracellular domain (ECD) of Rγc immobilized in microtiter wells. Phage binding was conducted in the presence and absence of synthetic test peptides to determine if phage peptides and test peptides competed for binding to the same sites on Rγc. Synthetic test peptides were selected to represent peptides from Rγc ligand families, as well as positive and negative control peptides.

A similar study was performed to evaluate the binding Rγc ligands. Rγc ligand family sequences and the specific Rγc ligands evaluated are provided in Table 11.

TABLE 11

Rγc ligand families and ligands.

| Rγc Ligand Family | Specific Rγc SEQ ID NO: | Peptide Sequence | | | | | | | | | | | | |
|---|---|---|---|---|---|---|---|---|---|---|---|---|---|---|
| 1A | 198 | K | V | C | E | M | W | G | G | V | L | L | C | W | N |
| 1A | 202 | R | T | C | T | E | W | E | N | V | V | L | C | W | V |
| 1B | 224 | D | C | S | M | W | E | J | G | V | E | L | C | W | |
| 2 | 236 | M | C | W | L | E | W | G | E | W | V | G | S | C | L |
| 3 | 248[1] | D | L | S | D | L | S | T | F | W | L | S | Q | | |
| 4 | 266 | C | P | S | M | L | Q | G | P | E | R | T | W | V | C |
| 5 | 930 | S | L | L | K | C | Y | N | A | S | T | C | A | S | V | F |
| IL-2Rβ Ligand | 58 | Y | D | C | R | I | A | Q | V | G | E | L | C | D | L |

[1] Modified ligand having amino acid SEQ ID NO: 248.

The Rγc ligands had a binding affinity ($IC_{50}$) to the Rγc subunit of less than 10 μM and a binding affinity ($IC_{50}$) to the IL-2Rβ subunit of greater than 100 μM.

Phage binding to the immobilized Rγc ECD was detected an antibody against phage coat proteins (anti-phage antibody HRP conjugate), followed by addition of TMB substrate solution and quantified by measuring absorbance in a microtiter plate reader.

The ELISA signal for each phage binding in the presence and absence of the test peptides was compared to determine which synthetic peptides competed with which phage peptides for binding to the Rγc subunit. The peptide pairs that exhibited competitive binding (i.e., cross inhibition) were considered to bind at the same functional site on IL-7R.

The results of the competitive binding assay are presented in Table 12.

TABLE 12

Binding of Rγc ligands to the Rγc subunit.

| | Rγc Ligand | Phage Clone | | | | | |
|---|---|---|---|---|---|---|---|
| Rγc Ligand SEQ ID NO: | SEQ ID NO: Rγc Family | 198 1A | 224 1B | 236 2 | 248 3 | 266 4 | 930 5 |
| 202 | 1A | +[1] | + | + | + | + | − |
| 224 | 1B | + | + | + | + | + | − |
| 236 | 2 | + | + | + | + | + | − |
| 248 | 3 | + | + | + | + | + | − |
| 930 | 5 | −[2] | − | − | − | − | + |
| 58 | IL-2Rβ Ligand | − | − | − | − | − | − |

[1] Rγc ligand competes with phage binding.
[2] Rγc ligand does not compete with phage binding.

Example 14

Competitive Binding of IL-7Rαγc Ligands

A competition binding assay was used to characterize the IL-7Rα binding site of an IL-7Rα ligand comprising SEQ ID NOS: 420-434 or 454 and an IL-7Rαγc ligand having SEQ ID NO 2012. The IL-7Rα ligands comprising SEQ ID NOS: 420-434 or 454 including a peptide having the amino acid sequence with two glycines (-GG-) (SEQ ID NO: 9399) on the carboxyl terminus.

The competition binding ELISA is described in Example 7. In this example, bn407::NA-HRP precomplexes were made using C-terminal biotinylated forms of the IL-7Rα ligand.

The $IC_{50}$ (M) VALUE for each the ligand is presented in Table 13.

TABLE 13

Competitive binding assay.

| IL-7Rα Ligand | Competitive Binding ELISA bn407: NA-HRP (10 nMf) $IC_{50}$ M |
|---|---|
| SEQ ID NO: 420 | 7.05E-7 |
| SEQ ID NO: 421 | 7.58E-6 |
| SEQ ID NO: 422 | 9.03E-7 |
| SEQ ID NO: 423 | 6.64E-7 |
| SEQ ID NO: 424 | 1.52E-6 |
| SEQ ID NO: 425 | 1.85E-6 |
| SEQ ID NO: 426 | 3.78E-7 |
| SEQ ID NO: 427 | 4.11E-7 |
| SEQ ID NO: 428 | 4.90E-7 |
| SEQ ID NO: 429 | 4.66E-7 |
| SEQ ID NO: 430 | 6.82E-7 |
| SEQ ID NO: 431 | 5.21E-7 |
| SEQ ID NO: 432 | 9.42E-7 |
| SEQ ID NO: 433 | 1.07E-6 |
| SEQ ID NO: 434 | 6.02E-7 |
| SEQ ID NO: 454 | 3.82E-7 |
| SEQ ID NO: 2012 | 4.67E-7 |

Example 15

TF-1-7α pSTAT5 Phosphorylation and Competitive Binding of IL-7Rαγc Ligands

IL-7Rαγc ligands H—O were synthesized using click chemistry as described in Example 2. The structures of IL-7Rαγc ligands H—O are shown in FIG. 13B.

IL-7Rαγc ligands having SEQ ID NOS: 2064-2073 were synthesized as described in Examples 1 and 2. The structures of IL-7Rαγc ligands are shown in Table 14.

TABLE 14

IL-7Rαγc ligands.

| SEQ ID NO: | Sequence |
|---|---|
| 2064 | VHRIPWCTLDPGGLQCAWLRQMGGGGSGGVVCQDWEGVELCWQPPA |
| 2065 | VHRIPWCTLDPGGLQCAWLRQGGGGSGGVVCQDWEGVELCWQPPA |
| 2066 | VHRIPWCTLDPGGLQCAWLRGGGGSGGVVCQDWEGVELCWQPPA |
| 9430 | VHRIPWCTLDPGGLQCAWLGKHGGGGSGGVVCQDWEGVELCWQPPA |
| 2068 | VHRIPWCTLDPGGLQCAWLRQGGGGGSGGVVCQDWEGVELCWQPPA |
| 2069 | VHRIPWCTLDPGGLQCAWLRGGGGGSGGVVCQDWEGVELCWQPPA |
| 2070 | VHRIPWCTLDPGGLQCAWLRQGGGGSGGVVCQDWEGVELCWQGG |
| 2071 | VHRIPWCTLDPGGLQCAWLRGGGGSGGVVCQDWEGVELCWQGG |
| 2072 | GWGIPWCTLDPGSLQCAWLGKHGGGGSGGVVCQDWEGVELCWQGG |
| 2073 | VHRIPWCTLDPGGLQCAWLRQM(PA)8GVVCQDWEGVELCWQGG |

STAT5 phosphorylation and competitive binding assays were performed as described in Examples 5 and 7, respectively. The results are presented in Table 15.

TABLE 15

Results of STAT5 phosphorylation and competitive binding assays.

| Construct No.: | TF-1Rα pSTAT5 ELISA EC50 (M) | Competitive Binding ELISA IL-7Rα | Competitive Binding ELISA Rγc |
|---|---|---|---|
| H | 6.7E−8 | 2.0E−7 | 3.6E−9 |
| I | >2.0E−6 | 1.7E−6 | 2.1E−8 |
| J | 2.3E−7 | 5.2E−8 | 2.9E−9 |
| K | >2.0E−6 | 1.7E−6 | 2.1E−8 |
| L | 1.3E−8 | 1.8E−7 | 5.6E−9 |
| M | 2.7E−8 | 2.7E−7 | 2.0E−9 |
| N | 4.6E−8 | 3.2E−7 | 8.7E−9 |
| O | 2.7E−8 | 1.6E−7 | 1.5E−8 |
| SEQ ID NO: 2064 | 1.5E−9 | 2.6E−7 | 7.9E−8 |
| SEQ ID NO: 2065 | 1.2E−8 | 6.6E−7 | 8.5E−8 |
| SEQ ID NO: 2066 | 5.3E−8 | 7.5E−7 | 7.6E−8 |
| SEQ ID NO: 2067 | 8.9E−8 | 8.8E−7 | 1.4E−7 |
| SEQ ID NO: 2068 | 2.0E−8 | 7.1E−7 | 1.1E−7 |
| SEQ ID NO: 2069 | 4.3E−8 | 5.8E−7 | 9.5E−8 |
| SEQ ID NO: 2070 | 1.2E−8 | 5.4E−7 | 1.8E−8 |
| SEQ ID NO: 2071 | 1.3E−8 | 3.9E−7 | 1.5E−8 |
| SEQ ID NO: 2072 | 1.5E−8 | 6.3E−7 | 2.3E−8 |
| SEQ ID NO: 2073 | 8.7E−8 | [1] | — |

[1]Not measured.

Example 16

Competition Binding of IL-7Rαγc Ligands to the Receptor Subunits

Figure 20:
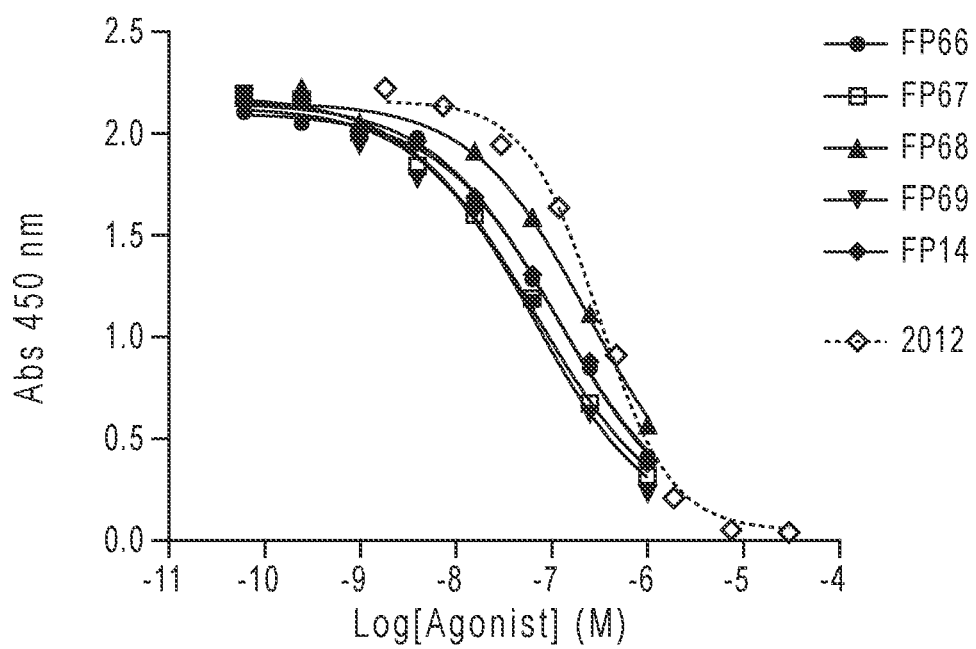
FIG. 20 shows the normalized ELISA signal for competitive binding of Fc-hIL-7Rα ligand fusion construct based on an IL-7Rα having SEQ ID NO: 402 1271 with a corresponding biotinylated/NA-HRP complex.
Figure 21:
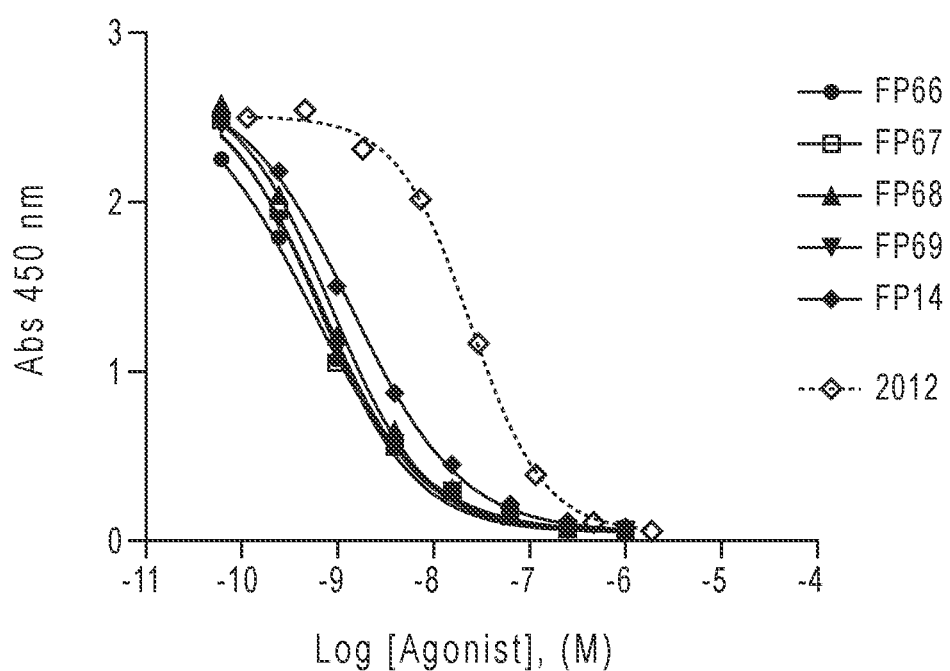
FIG. 21 shows the normalized ELISA signal for competitive binding of Fc-hIL-7Rα ligand fusion construct based on an Rγc having SEQ ID NO: 402 1099 with a corresponding biotinylated/NA-HRP complex.

Competitive binding assays were performed to measure the affinities of IL-7Rαγc ligands for the IL-7Rα and Rγc subunits. IL-7Rαγc-Fc constructs FP14 and FP66-FP69 and an IL-7Rαγc ligand having SEQ ID NO: 2012 were evaluated in this assay. The competition binding ELISA is described in Example 7. Receptor subunit ligands comprised of bn407::NA-HRP precomplexes (IL7Rα ligand) or bn1040::NA-HRP (-GGVVCQDWEGVELCWQGGR-; SEQ ID NO: 1040) precomplexes (Rγc ligand) were made using C-terminal biotinylated forms of each synthetic peptide. The results of the competition ELISA assays are shown in FIG. 20 (IL7Rα ligand) and FIG. 21 (Rγc ligand).

Finally, it should be noted that there are alternative ways of implementing the embodiments disclosed herein. Accordingly, the present embodiments are to be considered as illustrative and not restrictive, and the claims are not to be limited to the details given herein but may be modified within the scope and equivalents thereof.

SEQUENCE LISTING (9443 sequences)

SEQ ID NO: 1-4 - skipped (4 entries)

SEQ ID NO: 5 - protein, 14 aa, synthetic construct
  REGION 1..14: note = Description of Artificial Sequence: Synthetic peptide
QCIHWDIETLLSCV

SEQ ID NO: 6 - skipped

SEQ ID NO: 7 - protein, 14 aa, synthetic construct
  REGION 1..14: note = Description of Artificial Sequence: Synthetic peptide
TCQHQDLQGLLACI

SEQ ID NO: 8-14 - skipped (7 entries)

SEQ ID NO: 15 - protein, 16 aa, synthetic construct
  REGION 1..16: note = Description of Artificial Sequence: Synthetic peptide
DWLCRPGPGLLVCQWF

SEQ ID NO: 16-39 - skipped (24 entries)

SEQ ID NO: 40 - protein, 14 aa, synthetic construct
  REGION 1..14: note = Description of Artificial Sequence: Synthetic peptide
LYCAELHGFRVCRL

SEQ ID NO: 41-42 - skipped (2 entries)

SEQ ID NO: 43 - protein, 14 aa, synthetic construct
  REGION 1..14: note = Description of Artificial Sequence: Synthetic peptide
VYCAEIGEYRVCRQ

SEQ ID NO: 44-57 - skipped (14 entries)

SEQ ID NO: 58 - protein, 14 aa, synthetic construct
  REGION 1..14: note = Description of Artificial Sequence: Synthetic peptide
YDCRIAQVGELCDL

SEQ ID NO: 59 - skipped

SEQ ID NO: 60 - protein, 16 aa, synthetic construct
  REGION 1..16: note = Description of Artificial Sequence: Synthetic peptide
NIACMRFPGGYVCRNY

SEQ ID NO: 61-81 - skipped (21 entries)

SEQ ID NO: 82 - protein, 14 aa, synthetic construct
  REGION 1..14: note = Description of Artificial Sequence: Synthetic peptide
VCRTTRLDNWWGCR

SEQ ID NO: 83-86 - skipped (4 entries)

SEQ ID NO: 87 - protein, 14 aa, synthetic construct
  REGION 1..14: note = Description of Artificial Sequence: Synthetic peptide
HCRLQKPGFHRSSC

SEQ ID NO: 88-102 - skipped (15 entries)

SEQ ID NO: 103 - protein, 14 aa, synthetic construct
  REGION 1..14: note = Description of Artificial Sequence: Synthetic peptide
YWACSSGMNLCRWN

SEQ ID NO: 104 - protein, 14 aa, synthetic construct
  REGION 1..14: note = Description of Artificial Sequence: Synthetic peptide
YMACSSGLSLCRLS

SEQ ID NO: 105-114 - skipped (10 entries)

SEQ ID NO: 115 - protein, 14 aa, synthetic construct
  REGION 1..14: note = Description of Artificial Sequence: Synthetic peptide
DCYHWDLESLLACL

SEQ ID NO: 116-120 - skipped (5 entries)

SEQ ID NO: 121 - protein, 20 aa, synthetic construct
  REGION 1..20: note = Description of Artificial Sequence: Synthetic peptide
HCLHWDIETLMSCVYGNFEE

SEQ ID NO: 122-145 - skipped (24 entries)

SEQ ID NO: 146 - protein, 20 aa, synthetic construct
  REGION 1..20: note = Description of Artificial Sequence: Synthetic peptide
QCVHWDLDTLFGCIREQLEL

SEQ ID NO: 147-176 - skipped (30 entries)

SEQ ID NO: 177 - protein, 20 aa, synthetic construct
  REGION 1..20: note = Description of Artificial Sequence: Synthetic peptide
YCMHWDLESLLWCVHRKELE

SEQ ID NO: 178-192 - skipped (15 entries)

SEQ ID NO: 193 - protein, 22 aa, synthetic construct
  REGION 1..22: note = Description of Artificial Sequence: Synthetic peptide
DRMVTGIPWCLLDPGSIQCAWL

SEQ ID NO: 194-197 - skipped (4 entries)

SEQ ID NO: 198 - protein, 14 aa, synthetic construct
  REGION 1..14: note = Description of Artificial Sequence: Synthetic peptide
KVCEMWGGVLLCWN

SEQ ID NO: 199-201 - skipped (3 entries)

SEQ ID NO: 202 - protein, 14 aa, synthetic construct
  REGION 1..14: note = Description of Artificial Sequence: Synthetic peptide
RTCTEWENVVLCWV

SEQ ID NO: 203-209 - skipped (7 entries)

SEQ ID NO: 210 - protein, 22 aa, synthetic construct
  REGION 1..22: note = Description of Artificial Sequence: Synthetic peptide
IPWCTLDPGSVQCDYLLKSAKQ

SEQ ID NO: 211-223 - skipped (13 entries)

SEQ ID NO: 224 - protein, 12 aa, synthetic construct
  REGION 1..12: note = Description of Artificial Sequence: Synthetic peptide
DCSMWEGVELCW

SEQ ID NO: 225-235 - skipped (11 entries)

SEQ ID NO: 236 - protein, 14 aa, synthetic construct
  REGION 1..14: note = Description of Artificial Sequence: Synthetic peptide
MCWLEWGEWVGSCL

SEQ ID NO: 237-265 - skipped (29 entries)

SEQ ID NO: 266 - protein, 14 aa, synthetic construct
  REGION 1..14: note = Description of Artificial Sequence: Synthetic peptide
CPSMLQGPERTWVC

SEQ ID NO: 267-312 - skipped (46 entries)

SEQ ID NO: 313 - protein, 18 aa, synthetic construct
  REGION 1..18: note = Description of Artificial Sequence: Synthetic peptide
GGVPWCTLDPGSLQCAWF

SEQ ID NO: 314-334 - skipped (21 entries)

SEQ ID NO: 335 - protein, 22 aa, synthetic construct
  REGION 1..22: note = Description of Artificial Sequence: Synthetic peptide
VPWCVLDPGSIQCEYLQRLHRQ

SEQ ID NO: 336-380 - skipped (45 entries)

SEQ ID NO: 381 - protein, 16 aa, synthetic construct
  REGION 1..16: note = Description of Artificial Sequence: Synthetic peptide
RIECAELPGGFTCRLR

SEQ ID NO: 382-383 - skipped (2 entries)

SEQ ID NO: 384 - protein, 16 aa, synthetic construct
  REGION 1..16: note = Description of Artificial Sequence: Synthetic peptide
RYECADLPGGLHCEFR

SEQ ID NO: 385-392 - skipped (8 entries)

SEQ ID NO: 393 - protein, 20 aa, synthetic construct
  REGION 1..20: note = Description of Artificial Sequence: Synthetic peptide
HCLHWNIETLMSCVYGNFEE

SEQ ID NO: 394 - protein, 14 aa, synthetic construct
  REGION 1..14: note = Description of Artificial Sequence: Synthetic peptide
HCKHWDLESLLLCV

SEQ ID NO: 395 - protein, 22 aa, synthetic construct
  REGION 1..22: note = Description of Artificial Sequence: Synthetic peptide
HLGVPWCTLDPGSIQCAWLAKH

SEQ ID NO: 396 - protein, 22 aa, synthetic construct
  REGION 1..22: note = Description of Artificial Sequence: Synthetic peptide
IRSCLWQPGALHCTWWAEEEPV

SEQ ID NO: 397 - protein, 16 aa, synthetic construct
  REGION 1..16: note = Description of Artificial Sequence: Synthetic peptide
IPWCLLDPGGLQCVWL

SEQ ID NO: 398 - protein, 22 aa, synthetic construct
  REGION 1..22: note = Description of Artificial Sequence: Synthetic peptide
KAGSWFIPWCTLDPGSLQCAFL

SEQ ID NO: 399 - protein, 22 aa, synthetic construct
  REGION 1..22: note = Description of Artificial Sequence: Synthetic peptide
NPFRSVVPWCALDPGSLQCAWL

SEQ ID NO: 400 - protein, 14 aa, synthetic construct
  REGION 1..14: note = Description of Artificial Sequence: Synthetic peptide
QCIHWDIETLLSCV

SEQ ID NO: 401 - protein, 20 aa, synthetic construct
  REGION 1..20: note = Description of Artificial Sequence: Synthetic peptide
QCIHWDLESLLNCLRELKEP

SEQ ID NO: 402 - protein, 20 aa, synthetic construct
  REGION 1..20: note = Description of Artificial Sequence: Synthetic peptide
QCVHWDLDTLFGCIREQLEL

SEQ ID NO: 403 - protein, 22 aa, synthetic construct
  REGION 1..22: note = Description of Artificial Sequence: Synthetic peptide
RHFDDIIPWCTLDPGSLQCAYL

SEQ ID NO: 404 - protein, 20 aa, synthetic construct
  REGION 1..20: note = Description of Artificial Sequence: Synthetic peptide
SAKVLKQCLHWDLESLLSCL

SEQ ID NO: 405 - protein, 22 aa, synthetic construct
  REGION 1..22: note = Description of Artificial Sequence: Synthetic peptide
SLTVPWCTLDPGSMQCAWLQNR

SEQ ID NO: 406 - protein, 16 aa, synthetic construct
  REGION 1..16: note = Description of Artificial Sequence: Synthetic peptide
VPWCMLDPGSMQCAWL

SEQ ID NO: 407 - protein, 22 aa, synthetic construct
  REGION 1..22: note = Description of Artificial Sequence: Synthetic peptide
VHRIPWCTLDPGGLQCAWLRQM

SEQ ID NO: 408 - protein, 22 aa, synthetic construct
  REGION 1..22: note = Description of Artificial Sequence: Synthetic peptide
WVTIPWCILDPGSLQCEWQTKV

SEQ ID NO: 409 - protein, 22 aa, synthetic construct
  REGION 1..22: note = Description of Artificial Sequence: Synthetic peptide
GWGIPWCTLDPGSLQCAWLGKH

SEQ ID NO: 410 - protein, 22 aa, synthetic construct
  REGION 1..22: note = Description of Artificial Sequence: Synthetic peptide
YRSGHGIPWCMLDPGGLQCSWL

SEQ ID NO: 411-419 - skipped (9 entries)

SEQ ID NO: 420 - protein, 19 aa, synthetic construct
  REGION 1..19: note = Description of Artificial Sequence: Synthetic peptide
IPWCTLDPGGLQCAWLRQM

SEQ ID NO: 421 - protein, 19 aa, synthetic construct
  REGION 1..19: note = Description of Artificial Sequence: Synthetic peptide
IPWCTLDPGGLQCAALRQM

SEQ ID NO: 422 - protein, 19 aa, synthetic construct
  REGION 1..19: note = Description of Artificial Sequence: Synthetic peptide
IPWCTLDPGGLQCAFLRQM

SEQ ID NO: 423 - protein, 19 aa, synthetic construct
  REGION 1..19: note = Description of Artificial Sequence: Synthetic peptide
IPWCTLDPGGLQCAYLRQM

SEQ ID NO: 424 - protein, 19 aa, synthetic construct
  REGION 1..19: note = Description of Artificial Sequence: Synthetic peptide
IPWCTLDPGGLQCAHLRQM

SEQ ID NO: 425 - protein, 19 aa, synthetic construct
  REGION 1..19: note = Description of Artificial Sequence: Synthetic peptide
IPWCTLDPGGLQCAWARQM

SEQ ID NO: 426 - protein, 19 aa, synthetic construct
  REGION 1..19: note = Description of Artificial Sequence: Synthetic peptide
IPWCTLDPGGLQCAWIRQM

SEQ ID NO: 427 - protein, 19 aa, synthetic construct
  REGION 1..19: note = Description of Artificial Sequence: Synthetic peptide
IPWCTLDPGGLQCAWVRQM

SEQ ID NO: 428 - protein, 19 aa, synthetic construct
  REGION 1..19: note = Description of Artificial Sequence: Synthetic peptide
IPWCTLDPGGLQCAWLAQM

SEQ ID NO: 429 - protein, 19 aa, synthetic construct
  REGION 1..19: note = Description of Artificial Sequence: Synthetic peptide
IPWCTLDPGGLQCAWLKQM

SEQ ID NO: 430 - protein, 19 aa, synthetic construct
  REGION 1..19: note = Description of Artificial Sequence: Synthetic peptide
IPWCTLDPGGLQCAWLHQM

SEQ ID NO: 431 - protein, 19 aa, synthetic construct
  REGION 1..19: note = Description of Artificial Sequence: Synthetic peptide
IPWCTLDPGGLQCAWLRAM

SEQ ID NO: 432 - protein, 19 aa, synthetic construct
  REGION 1..19: note = Description of Artificial Sequence: Synthetic peptide
IPWCTLDPGGLQCAWLRQA

SEQ ID NO: 433 - protein, 19 aa, synthetic construct
  REGION 1..19: note = Description of Artificial Sequence: Synthetic peptide
IPWCTLDPGGLQCAWLRAA

SEQ ID NO: 434 - protein, 19 aa, synthetic construct
  REGION 1..19: note = Description of Artificial Sequence: Synthetic peptide
IPWCTLDPGGLQCAWLAAA

SEQ ID NO: 435 - protein, 18 aa, synthetic construct
  REGION 1..18: note = Description of Artificial Sequence: Synthetic peptide
IPWCTLDPGGLQCAWLRQ

SEQ ID NO: 436 - protein, 17 aa, synthetic construct
  REGION 1..17: note = Description of Artificial Sequence: Synthetic peptide
IPWCTLDPGGLQCAWLR

SEQ ID NO: 437 - protein, 16 aa, synthetic construct
  REGION 1..16: note = Description of Artificial Sequence: Synthetic peptide
IPWCTLDPGGLQCAWL

SEQ ID NO: 438 - protein, 15 aa, synthetic construct
  REGION 1..15: note = Description of Artificial Sequence: Synthetic peptide
IPWCTLDPGGLQCAW

SEQ ID NO: 439 - protein, 21 aa, synthetic construct
  REGION 1..21: note = Description of Artificial Sequence: Synthetic peptide
IPWCTLDPGGLQCAWLRQMGG

SEQ ID NO: 440 - protein, 20 aa, synthetic construct
  REGION 1..20: note = Description of Artificial Sequence: Synthetic peptide
IPWCTLDPGGLQCAWLRQGG

SEQ ID NO: 441 - protein, 19 aa, synthetic construct
  REGION 1..19: note = Description of Artificial Sequence: Synthetic peptide
IPWCTLDPGGLQCAWLRGG

SEQ ID NO: 442 - protein, 18 aa, synthetic construct
  REGION 1..18: note = Description of Artificial Sequence: Synthetic peptide
IPWCTLDPGGLQCAWLGG

SEQ ID NO: 443 - protein, 17 aa, synthetic construct
  REGION 1..17: note = Description of Artificial Sequence: Synthetic peptide
IPWCTLDPGGLQCAWGG

SEQ ID NO: 444 - protein, 21 aa, synthetic construct
  REGION 1..21: note = Description of Artificial Sequence: Synthetic peptide
GGIPWCTLDPGGLQCAWLRQM

SEQ ID NO: 445 - protein, 20 aa, synthetic construct
  REGION 1..20: note = Description of Artificial Sequence: Synthetic peptide
GGIPWCTLDPGGLQCAWLRQ

SEQ ID NO: 446 - protein, 19 aa, synthetic construct
  REGION 1..19: note = Description of Artificial Sequence: Synthetic peptide
GGIPWCTLDPGGLQCAWLR

SEQ ID NO: 447 - protein, 18 aa, synthetic construct
  REGION 1..18: note = Description of Artificial Sequence: Synthetic peptide
GGIPWCTLDPGGLQCAWL

SEQ ID NO: 448 - protein, 17 aa, synthetic construct
  REGION 1..17: note = Description of Artificial Sequence: Synthetic peptide
GGIPWCTLDPGGLQCAW

SEQ ID NO: 449 - protein, 23 aa, synthetic construct
  REGION 1..23: note = Description of Artificial Sequence: Synthetic peptide
GGIPWCTLDPGGLQCAWLRQMGG

SEQ ID NO: 450 - protein, 22 aa, synthetic construct
  REGION 1..22: note = Description of Artificial Sequence: Synthetic peptide
GGIPWCTLDPGGLQCAWLRQGG

SEQ ID NO: 451 - protein, 21 aa, synthetic construct
  REGION 1..21: note = Description of Artificial Sequence: Synthetic peptide
GGIPWCTLDPGGLQCAWLRGG

SEQ ID NO: 452 - protein, 20 aa, synthetic construct
  REGION 1..20: note = Description of Artificial Sequence: Synthetic peptide
GGIPWCTLDPGGLQCAWLGG

SEQ ID NO: 453 - protein, 19 aa, synthetic construct
  REGION 1..19: note = Description of Artificial Sequence: Synthetic peptide
GGIPWCTLDPGGLQCAWGG

SEQ ID NO: 454 - protein, 24 aa, synthetic construct
  REGION 1..24: note = Description of Artificial Sequence: Synthetic peptide
VHRIPWCTLDPGGLQCAWLRQMGG

SEQ ID NO: 455 - protein, 24 aa, synthetic construct
  REGION 1..24: note = Description of Artificial Sequence: Synthetic peptide
GGVHRIPWCTLDPGGLQCAWLRQM

SEQ ID NO: 456 - protein, 26 aa, synthetic construct
  REGION 1..26: note = Description of Artificial Sequence: Synthetic peptide
GGVHRIPWCTLDPGGLQCAWLRQMGG

SEQ ID NO: 457 - protein, 21 aa, synthetic construct
  REGION 1..21: note = Description of Artificial Sequence: Synthetic peptide
VHRIPWCTLDPGGLQCAWLRQ

SEQ ID NO: 458 - protein, 20 aa, synthetic construct
  REGION 1..20: note = Description of Artificial Sequence: Synthetic peptide
VHRIPWCTLDPGGLQCAWLR

SEQ ID NO: 459 - protein, 21 aa, synthetic construct
  REGION 1..21: note = Description of Artificial Sequence: Synthetic peptide
VHRIPWCTLDPGGLQCAWLRM

SEQ ID NO: 460 - protein, 23 aa, synthetic construct
  REGION 1..23: note = Description of Artificial Sequence: Synthetic peptide
GGVHRIPWCTLDPGGLQCAWLRQ

SEQ ID NO: 461 - protein, 22 aa, synthetic construct
  REGION 1..22: note = Description of Artificial Sequence: Synthetic peptide
GGVHRIPWCTLDPGGLQCAWLR

SEQ ID NO: 462 - protein, 23 aa, synthetic construct
  REGION 1..23: note = Description of Artificial Sequence: Synthetic peptide
GGVHRIPWCTLDPGGLQCAWLRM

SEQ ID NO: 463 - protein, 22 aa, synthetic construct
  REGION 1..22: note = Description of Artificial Sequence: Synthetic peptide
VHRIPWCTLDPGGLQCAWARQM

SEQ ID NO: 464 - protein, 24 aa, synthetic construct
  REGION 1..24: note = Description of Artificial Sequence: Synthetic peptide
VHRIPWCTLDPGGLQCAWARQMGG

SEQ ID NO: 465 - protein, 24 aa, synthetic construct
  REGION 1..24: note = Description of Artificial Sequence: Synthetic peptide
GGVHRIPWCTLDPGGLQCAWARQM

SEQ ID NO: 466 - protein, 26 aa, synthetic construct
  REGION 1..26: note = Description of Artificial Sequence: Synthetic peptide
GGVHRIPWCTLDPGGLQCAWARQMGG

SEQ ID NO: 467 - protein, 22 aa, synthetic construct
  REGION 1..22: note = Description of Artificial Sequence: Synthetic peptide
VHRIPWCTLDPGGLQCAWVRQM

SEQ ID NO: 468 - protein, 24 aa, synthetic construct
  REGION 1..24: note = Description of Artificial Sequence: Synthetic peptide
VHRIPWCTLDPGGLQCAWVRQMGG

SEQ ID NO: 469 - protein, 24 aa, synthetic construct
  REGION 1..24: note = Description of Artificial Sequence: Synthetic peptide
GGVHRIPWCTLDPGGLQCAWVRQM

SEQ ID NO: 470 - protein, 26 aa, synthetic construct
  REGION 1..26: note = Description of Artificial Sequence: Synthetic peptide
GGVHRIPWCTLDPGGLQCAWVRQMGG

SEQ ID NO: 471 - protein, 22 aa, synthetic construct
  REGION 1..22: note = Description of Artificial Sequence: Synthetic peptide
VHRIPWCTLDPGGLQCAWIRQM

SEQ ID NO: 472 - protein, 24 aa, synthetic construct
  REGION 1..24: note = Description of Artificial Sequence: Synthetic peptide
VHRIPWCTLDPGGLQCAWIRQMGG

SEQ ID NO: 473 - protein, 24 aa, synthetic construct
  REGION 1..24: note = Description of Artificial Sequence: Synthetic peptide
GGVHRIPWCTLDPGGLQCAWIRQM

SEQ ID NO: 474 - protein, 26 aa, synthetic construct
  REGION 1..26: note = Description of Artificial Sequence: Synthetic peptide
GGVHRIPWCTLDPGGLQCAWIRQMGG

SEQ ID NO: 475 - protein, 20 aa, synthetic construct
  REGION 1..20: note = Description of Artificial Sequence: Synthetic peptide
IEGRGGQCIHWDIETLLSCV

SEQ ID NO: 476 - protein, 22 aa, synthetic construct
  REGION 1..22: note = Description of Artificial Sequence: Synthetic peptide
IEGRGGVPWCTLDPGSLQCAWF

SEQ ID NO: 477 - protein, 22 aa, synthetic construct
  REGION 1..22: note = Description of Artificial Sequence: Synthetic peptide
IEGRGGRYECADLPGGLHCEFR

SEQ ID NO: 478 - protein, 21 aa, synthetic construct
  REGION 1..21: note = Description of Artificial Sequence: Synthetic peptide
RSCLWQPGALHCTWWAEEEPV

SEQ ID NO: 479 - protein, 22 aa, synthetic construct
  REGION 1..22: note = Description of Artificial Sequence: Synthetic peptide
GGIEGRGGQCIHWDIETLLSCV

SEQ ID NO: 480 - protein, 24 aa, synthetic construct
  REGION 1..24: note = Description of Artificial Sequence: Synthetic peptide
GGIEGRGGVPWCTLDPGSLQCAWF

SEQ ID NO: 481 - protein, 24 aa, synthetic construct
  REGION 1..24: note = Description of Artificial Sequence: Synthetic peptide
GGIEGRGGRYECADLPGGLHCEFR

SEQ ID NO: 482 - protein, 23 aa, synthetic construct
  REGION 1..23: note = Description of Artificial Sequence: Synthetic peptide
GGRSCLWQPGALHCTWWAEEEPV

SEQ ID NO: 483 - protein, 22 aa, synthetic construct
  REGION 1..22: note = Description of Artificial Sequence: Synthetic peptide
QCVHWDLDTLFGCIREQLELGG

SEQ ID NO: 484 - protein, 22 aa, synthetic construct
  REGION 1..22: note = Description of Artificial Sequence: Synthetic peptide
GGQCVHWDLDTLFGCIREQLEL

SEQ ID NO: 485 - protein, 24 aa, synthetic construct
  REGION 1..24: note = Description of Artificial Sequence: Synthetic peptide
GGQCVHWDLDTLFGCIREQLELGG

SEQ ID NO: 486 - protein, 26 aa, synthetic construct
  REGION 1..26: note = Description of Artificial Sequence: Synthetic peptide
GGHLGVPWCTLDPGSIQCAWLAKHGG

SEQ ID NO: 487 - protein, 18 aa, synthetic construct
  REGION 1..18: note = Description of Artificial Sequence: Synthetic peptide
VHRIPWCTLDPGGLQCAW

SEQ ID NO: 488 - protein, 17 aa, synthetic construct
  REGION 1..17: note = Description of Artificial Sequence: Synthetic peptide
VHRIPWCTLDPGGLQCA

SEQ ID NO: 489 - protein, 16 aa, synthetic construct
  REGION 1..16: note = Description of Artificial Sequence: Synthetic peptide
VHRIPWCTLDPGGLQC

SEQ ID NO: 490 - protein, 23 aa, synthetic construct
  REGION 1..23: note = Description of Artificial Sequence: Synthetic peptide
HRIPWCTLDPGGLQCAWLRQMGG

SEQ ID NO: 491 - protein, 22 aa, synthetic construct
  REGION 1..22: note = Description of Artificial Sequence: Synthetic peptide
RIPWCTLDPGGLQCAWLRQMGG

SEQ ID NO: 492 - protein, 21 aa, synthetic construct
  REGION 1..21: note = Description of Artificial Sequence: Synthetic peptide
IPWCTLDPGGLQCAWLRQMGG

SEQ ID NO: 493 - protein, 20 aa, synthetic construct
  REGION 1..20: note = Description of Artificial Sequence: Synthetic peptide
PWCTLDPGGLQCAWLRQMGG

SEQ ID NO: 494 - protein, 19 aa, synthetic construct
  REGION 1..19: note = Description of Artificial Sequence: Synthetic peptide
WCTLDPGGLQCAWLRQMGG

SEQ ID NO: 495 - protein, 18 aa, synthetic construct
  REGION 1..18: note = Description of Artificial Sequence: Synthetic peptide
CTLDPGGLQCAWLRQMGG

SEQ ID NO: 496 - protein, 18 aa, synthetic construct
  REGION 1..18: note = Description of Artificial Sequence: Synthetic peptide
CTLDPGGLQCAWLRQMGG

SEQ ID NO: 497 - protein, 16 aa, synthetic construct
  REGION 1..16: note = Description of Artificial Sequence: Synthetic peptide
GQCIHWDIETLLSCVG

SEQ ID NO: 498 - protein, 18 aa, synthetic construct
  REGION 1..18: note = Description of Artificial Sequence: Synthetic peptide
GGQCIHWDIETLLSCVGG

SEQ ID NO: 499 - protein, 18 aa, synthetic construct
  REGION 1..18: note = Description of Artificial Sequence: Synthetic peptide
GGGQCIHWDIETLLSCVG

SEQ ID NO: 500 - protein, 22 aa, synthetic construct
  REGION 1..22: note = Description of Artificial Sequence: Synthetic peptide
  VARIANT 1: note = A, G, P, S, T, or V
  VARIANT 2: note = F, H, W, or Y
  VARIANT 3: note = A, G, H, K, P, R, S, or T
  VARIANT 13: note = A, G, P, S, or T
  VARIANT 20: note = A, G, H, K, P, R, S, or T
  VARIANT 21: note = Any amino acid or absent
  VARIANT 22: note = Any amino acid or absent
XXXIPWCTLDPGXLQCAWLXXX

SEQ ID NO: 501 - protein, 21 aa, synthetic construct
  REGION 1..21: note = Description of Artificial Sequence: Synthetic peptide
  VARIANT 1: note = F, H, W, or Y
  VARIANT 2: note = A, G, H, K, P, R, S, or T
  VARIANT 12: note = A, G, P, S, or T
  VARIANT 19: note = A, G, H, K, P, R, S, or T
  VARIANT 20: note = Any amino acid or absent
  VARIANT 21: note = Any amino acid or absent
XXIPWCTLDPGXLQCAWLXXX

SEQ ID NO: 502 - protein, 20 aa, synthetic construct
  REGION 1..20: note = Description of Artificial Sequence: Synthetic peptide
  VARIANT 1: note = A, G, H, K, P, R, S, or T
  VARIANT 11: note = A, G, P, S, or T
  VARIANT 18: note = A, G, H, K, P, R, S, or T
  VARIANT 19: note = Any amino acid or absent
  VARIANT 20: note = Any amino acid or absent
XIPWCTLDPGXLQCAWLXXX

SEQ ID NO: 503 - protein, 19 aa, synthetic construct
  REGION 1..19: note = Description of Artificial Sequence: Synthetic peptide
  VARIANT 10: note = A, G, P, S, or T
  VARIANT 17: note = A, G, H, K, P, R, S, or T
  VARIANT 18: note = Any amino acid or absent
  VARIANT 19: note = Any amino acid or absent
IPWCTLDPGXLQCAWLXXX

SEQ ID NO: 504 - protein, 21 aa, synthetic construct
  REGION 1..21: note = Description of Artificial Sequence: Synthetic peptide
  VARIANT 1: note = A, G, P, S, T, or V
  VARIANT 2: note = F, H, W, or Y
  VARIANT 3: note = A, G, H, K, P, R, S, or T
  VARIANT 13: note = A, G, P, S, or T
  VARIANT 20: note = A, G, H, K, P, R, S, or T
  VARIANT 21: note = Any amino acid or absent
XXXIPWCTLDPGXLQCAWLXX

SEQ ID NO: 505 - protein, 20 aa, synthetic construct
  REGION 1..20: note = Description of Artificial Sequence: Synthetic peptide
  VARIANT 1: note = A, G, P, S, T, or V
  VARIANT 2: note = F, H, W, or Y
  VARIANT 3: note = A, G, H, K, P, R, S, or T
  VARIANT 13: note = A, G, P, S, or T
  VARIANT 20: note = A, G, H, K, P, R, S, or T
XXXIPWCTLDPGXLQCAWLX

SEQ ID NO: 506 - protein, 19 aa, synthetic construct
  REGION 1..19: note = Description of Artificial Sequence: Synthetic peptide
  VARIANT 1: note = A, G, P, S, T, or V
  VARIANT 2: note = F, H, W, or Y
  VARIANT 3: note = A, G, H, K, P, R, S, or T
  VARIANT 13: note = A, G, P, S, or T
XXXIPWCTLDPGXLQCAWL

SEQ ID NO: 507 - protein, 18 aa, synthetic construct
  REGION 1..18: note = Description of Artificial Sequence: Synthetic peptide
  VARIANT 1: note = A, G, P, S, T, or V
  VARIANT 2: note = F, H, W, or Y
  VARIANT 3: note = A, G, H, K, P, R, S, or T
  VARIANT 12: note = A, G, P, S, or T
XXXIPWCTLDPXLQCAWL

SEQ ID NO: 508 - protein, 18 aa, synthetic construct
  REGION 1..18: note = Description of Artificial Sequence: Synthetic peptide
IPWCTLDPGGLQCAWLRG

SEQ ID NO: 509 - protein, 19 aa, synthetic construct
  REGION 1..19: note = Description of Artificial Sequence: Synthetic peptide
IPWCTLDPGGLQCAWLRQG

SEQ ID NO: 510 - protein, 19 aa, synthetic construct
  REGION 1..19: note = Description of Artificial Sequence: Synthetic peptide
IPWCTLDPGGLQCAWLRGG

SEQ ID NO: 511 - protein, 17 aa, synthetic construct
  REGION 1..17: note = Description of Artificial Sequence: Synthetic peptide
IPWCTLDPGGLQCAWLG

SEQ ID NO: 512 - protein, 18 aa, synthetic construct
  REGION 1..18: note = Description of Artificial Sequence: Synthetic peptide
IPWCTLDPGGLQCAWLGK

SEQ ID NO: 513 - protein, 19 aa, synthetic construct
  REGION 1..19: note = Description of Artificial Sequence: Synthetic peptide
IPWCTLDPGGLQCAWLGKH

SEQ ID NO: 514 - protein, 19 aa, synthetic construct
  REGION 1..19: note = Description of Artificial Sequence: Synthetic peptide
VHRIPWCTLDPGGLQCAWL

SEQ ID NO: 515 - protein, 21 aa, synthetic construct
  REGION 1..21: note = Description of Artificial Sequence: Synthetic peptide
VHRIPWCTLDPGGLQCAWLRG

SEQ ID NO: 516 - protein, 22 aa, synthetic construct
  REGION 1..22: note = Description of Artificial Sequence: Synthetic peptide
VHRIPWCTLDPGGLQCAWLRQG

SEQ ID NO: 517 - protein, 22 aa, synthetic construct
  REGION 1..22: note = Description of Artificial Sequence: Synthetic peptide
VHRIPWCTLDPGGLQCAWLRGG

SEQ ID NO: 518 - protein, 20 aa, synthetic construct
  REGION 1..20: note = Description of Artificial Sequence: Synthetic peptide
VHRIPWCTLDPGGLQCAWLG

SEQ ID NO: 519 - protein, 21 aa, synthetic construct
  REGION 1..21: note = Description of Artificial Sequence: Synthetic peptide
VHRIPWCTLDPGGLQCAWLGK

SEQ ID NO: 520 - protein, 22 aa, synthetic construct
  REGION 1..22: note = Description of Artificial Sequence: Synthetic peptide
VHRIPWCTLDPGGLQCAWLGKH

SEQ ID NO: 521 - protein, 19 aa, synthetic construct
  REGION 1..19: note = Description of Artificial Sequence: Synthetic peptide
GWGIPWCTLDPGGLQCAWL

SEQ ID NO: 522 - protein, 20 aa, synthetic construct
  REGION 1..20: note = Description of Artificial Sequence: Synthetic peptide
GWGIPWCTLDPGGLQCAWLR

SEQ ID NO: 523 - protein, 21 aa, synthetic construct
  REGION 1..21: note = Description of Artificial Sequence: Synthetic peptide
GWGIPWCTLDPGGLQCAWLRQ

SEQ ID NO: 524 - protein, 21 aa, synthetic construct
  REGION 1..21: note = Description of Artificial Sequence: Synthetic peptide
GWGIPWCTLDPGGLQCAWLRG

SEQ ID NO: 525 - protein, 22 aa, synthetic construct
  REGION 1..22: note = Description of Artificial Sequence: Synthetic peptide
GWGIPWCTLDPGGLQCAWLRQG

SEQ ID NO: 526 - protein, 22 aa, synthetic construct
  REGION 1..22: note = Description of Artificial Sequence: Synthetic peptide
GWGIPWCTLDPGGLQCAWLRGG

SEQ ID NO: 527 - protein, 20 aa, synthetic construct
  REGION 1..20: note = Description of Artificial Sequence: Synthetic peptide
GWGIPWCTLDPGGLQCAWLG

SEQ ID NO: 528 - protein, 21 aa, synthetic construct
  REGION 1..21: note = Description of Artificial Sequence: Synthetic peptide
GWGIPWCTLDPGGLQCAWLGK

SEQ ID NO: 529 - protein, 22 aa, synthetic construct
  REGION 1..22: note = Description of Artificial Sequence: Synthetic peptide
GWGIPWCTLDPGGLQCAWLGKH

SEQ ID NO: 530 - protein, 16 aa, synthetic construct
  REGION 1..16: note = Description of Artificial Sequence: Synthetic peptide
IPWCTLDPGSLQCAWL

SEQ ID NO: 531 - protein, 17 aa, synthetic construct
  REGION 1..17: note = Description of Artificial Sequence: Synthetic peptide
IPWCTLDPGSLQCAWLR

SEQ ID NO: 532 - protein, 18 aa, synthetic construct
  REGION 1..18: note = Description of Artificial Sequence: Synthetic peptide
IPWCTLDPGSLQCAWLRQ

SEQ ID NO: 533 - protein, 18 aa, synthetic construct
  REGION 1..18: note = Description of Artificial Sequence: Synthetic peptide
IPWCTLDPGSLQCAWLRG

SEQ ID NO: 534 - protein, 19 aa, synthetic construct
  REGION 1..19: note = Description of Artificial Sequence: Synthetic peptide
IPWCTLDPGSLQCAWLRQG

SEQ ID NO: 535 - protein, 19 aa, synthetic construct
  REGION 1..19: note = Description of Artificial Sequence: Synthetic peptide
IPWCTLDPGSLQCAWLRGG

SEQ ID NO: 536 - protein, 17 aa, synthetic construct
  REGION 1..17: note = Description of Artificial Sequence: Synthetic peptide
IPWCTLDPGSLQCAWLG

SEQ ID NO: 537 - protein, 18 aa, synthetic construct
  REGION 1..18: note = Description of Artificial Sequence: Synthetic peptide
IPWCTLDPGSLQCAWLGK

SEQ ID NO: 538 - protein, 19 aa, synthetic construct
  REGION 1..19: note = Description of Artificial Sequence: Synthetic peptide
IPWCTLDPGSLQCAWLGKH

SEQ ID NO: 539 - protein, 19 aa, synthetic construct
  REGION 1..19: note = Description of Artificial Sequence: Synthetic peptide
VHRIPWCTLDPGSLQCAWL

SEQ ID NO: 540 - protein, 20 aa, synthetic construct
  REGION 1..20: note = Description of Artificial Sequence: Synthetic peptide
VHRIPWCTLDPGSLQCAWLR

SEQ ID NO: 541 - protein, 21 aa, synthetic construct
  REGION 1..21: note = Description of Artificial Sequence: Synthetic peptide
VHRIPWCTLDPGSLQCAWLRQ

SEQ ID NO: 542 - protein, 21 aa, synthetic construct
  REGION 1..21: note = Description of Artificial Sequence: Synthetic peptide
VHRIPWCTLDPGSLQCAWLRG

SEQ ID NO: 543 - protein, 22 aa, synthetic construct
  REGION 1..22: note = Description of Artificial Sequence: Synthetic peptide
VHRIPWCTLDPGSLQCAWLRQG

SEQ ID NO: 544 - protein, 22 aa, synthetic construct
  REGION 1..22: note = Description of Artificial Sequence: Synthetic peptide
VHRIPWCTLDPGSLQCAWLRGG

SEQ ID NO: 545 - protein, 20 aa, synthetic construct
  REGION 1..20: note = Description of Artificial Sequence: Synthetic peptide
VHRIPWCTLDPGSLQCAWLG

SEQ ID NO: 546 - protein, 21 aa, synthetic construct
  REGION 1..21: note = Description of Artificial Sequence: Synthetic peptide
VHRIPWCTLDPGSLQCAWLGK

SEQ ID NO: 547 - protein, 22 aa, synthetic construct
  REGION 1..22: note = Description of Artificial Sequence: Synthetic peptide
VHRIPWCTLDPGSLQCAWLGKH

SEQ ID NO: 548 - protein, 19 aa, synthetic construct
  REGION 1..19: note = Description of Artificial Sequence: Synthetic peptide
GWGIPWCTLDPGSLQCAWL

SEQ ID NO: 549 - protein, 20 aa, synthetic construct
  REGION 1..20: note = Description of Artificial Sequence: Synthetic peptide
GWGIPWCTLDPGSLQCAWLR

SEQ ID NO: 550 - protein, 21 aa, synthetic construct
  REGION 1..21: note = Description of Artificial Sequence: Synthetic peptide
GWGIPWCTLDPGSLQCAWLRQ

SEQ ID NO: 551 - protein, 21 aa, synthetic construct
  REGION 1..21: note = Description of Artificial Sequence: Synthetic peptide
GWGIPWCTLDPGSLQCAWLRG

SEQ ID NO: 552 - protein, 22 aa, synthetic construct
  REGION 1..22: note = Description of Artificial Sequence: Synthetic peptide
GWGIPWCTLDPGSLQCAWLRQG

SEQ ID NO: 553 - protein, 22 aa, synthetic construct
  REGION 1..22: note = Description of Artificial Sequence: Synthetic peptide
GWGIPWCTLDPGSLQCAWLRGG

SEQ ID NO: 554 - protein, 20 aa, synthetic construct
  REGION 1..20: note = Description of Artificial Sequence: Synthetic peptide
GWGIPWCTLDPGSLQCAWLG

SEQ ID NO: 555 - protein, 21 aa, synthetic construct
  REGION 1..21: note = Description of Artificial Sequence: Synthetic peptide
GWGIPWCTLDPGSLQCAWLGK

SEQ ID NO: 556 - protein, 22 aa, synthetic construct
  REGION 1..22: note = Description of Artificial Sequence: Synthetic peptide
GWGIPWCTLDPGSLQCAWLGKH

SEQ ID NO: 557-581 - skipped (25 entries)

SEQ ID NO: 582 - protein, 23 aa, synthetic construct
  REGION 1..23: note = Description of Artificial Sequence: Synthetic peptide
GGRSCLWQPGALHCTWWAEEEPV

SEQ ID NO: 583-654 - skipped (72 entries)

SEQ ID NO: 655 - protein, 22 aa, synthetic construct
  REGION 1..22: note = Description of Artificial Sequence: Synthetic peptide
GWGIPWCTLDPGSLQCAWLGKH

SEQ ID NO: 656-929 - skipped (274 entries)

SEQ ID NO: 930 - protein, 15 aa, synthetic construct
  REGION 1..15: note = Description of Artificial Sequence: Synthetic peptide
SLLKCYNASTCASVF

SEQ ID NO: 931-943 - skipped (13 entries)

SEQ ID NO: 944 - protein, 20 aa, synthetic construct
  REGION 1..20: note = Description of Artificial Sequence: Synthetic peptide
  VARIANT 1: note = H, K, or R
  VARIANT 2: note = S, T, or Y
  VARIANT 3: note = D, E, F, I, L, M, V, W, or Y
  VARIANT 4: note = F, I, L, M, V, W, or Y
  VARIANT 5: note = D, E, F, I, L, M, V, W, or Y
  VARIANT 7: note = D, E, H, N, Q, S, T, or Y
  VARIANT 8: note = D or E
  VARIANT 9: note = F, H, I, L, M, V, W, or Y
  VARIANT 10: note = D, E, H, N, Q, S, T, or Y
  VARIANT 17: note = F, I, L, M, V, W, Y, H, N, Q, S, or T
  VARIANT 19: note = Any amino acid
  VARIANT 20: note = D or E
XXXXXCXXXXGVELCWXEXX

SEQ ID NO: 945 - protein, 18 aa, synthetic construct
  REGION 1..18: note = Description of Artificial Sequence: Synthetic peptide
  VARIANT 1: note = S, T, or Y
  VARIANT 2: note = D, E, F, I, L, M, V, W, or Y
  VARIANT 3: note = F, I, L, M, V, W, or Y
  VARIANT 4: note = D, E, F, I, L, M, V, W, or Y
  VARIANT 6: note = D, E, H, N, Q, S, T, or Y
  VARIANT 7: note = D or E
  VARIANT 8: note = F, H, I, L, M, V, W, or Y
  VARIANT 9: note = D, E, H, N, Q, S, T, or Y
  VARIANT 16: note = F, I, L, M, V, W, Y, H, N, Q, S, or T
  VARIANT 18: note = Any amino acid
XXXXCXXXXGVELCWXEX

SEQ ID NO: 946 - protein, 16 aa, synthetic construct
  REGION 1..16: note = Description of Artificial Sequence: Synthetic peptide
  VARIANT 1: note = D, E, F, I, L, M, V, W, or Y
  VARIANT 2: note = F, I, L, M, V, W, or Y
  VARIANT 3: note = D, E, F, I, L, M, V, W, or Y
  VARIANT 5: note = D, E, H, N, Q, S, T, or Y
  VARIANT 6: note = D or E
  VARIANT 7: note = F, H, I, L, M, V, W, or Y
  VARIANT 8: note = D, E, H, N, Q, S, T, or Y
  VARIANT 15: note = F, I, L, M, V, W, Y, H, N, Q, S, or T
XXXCXXXXGVELCWXE

SEQ ID NO: 947 - protein, 14 aa, synthetic construct
  REGION 1..14: note = Description of Artificial Sequence: Synthetic peptide
  VARIANT 1: note = F, I, L, M, V, W, or Y
  VARIANT 2: note = D, E, F, I, L, M, V, W, or Y
  VARIANT 4: note = D, E, H, N, Q, S, T, or Y
  VARIANT 5: note = D or E
  VARIANT 6: note = F, H, I, L, M, V, W, or Y
  VARIANT 7: note = D, E, H, N, Q, S, T, or Y
  VARIANT 14: note = F, I, L, M, V, W, Y, H, N, Q, S, or T
XXCXXXXGVELCWX

SEQ ID NO: 948 - protein, 12 aa, synthetic construct
  REGION 1..12: note = Description of Artificial Sequence: Synthetic peptide
  VARIANT 1: note = D, E, F, I, L, M, V, W, or Y
  VARIANT 3: note = D, E, H, N, Q, S, T, or Y
  VARIANT 4: note = D or E
  VARIANT 5: note = F, H, I, L, M, V, W, or Y
  VARIANT 6: note = D, E, H, N, Q, S, T, or Y
XCXXXXGVELCW

SEQ ID NO: 949 - protein, 10 aa, synthetic construct
  REGION 1..10: note = Description of Artificial Sequence: Synthetic peptide
  VARIANT 2: note = D, E, H, N, Q, S, T, or Y
  VARIANT 3: note = D or E
  VARIANT 4: note = F, H, I, L, M, V, W, or Y
  VARIANT 5: note = D, E, H, N, Q, S, T, or Y
CXXXXGVELC

SEQ ID NO: 950 - protein, 14 aa, synthetic construct
  REGION 1..14: note = Description of Artificial Sequence: Synthetic peptide
IECDTSYGVYICWQ

SEQ ID NO: 951 - protein, 14 aa, synthetic construct
  REGION 1..14: note = Description of Artificial Sequence: Synthetic peptide
IECEEWRGVELCWQ

SEQ ID NO: 952 - protein, 20 aa, synthetic construct
  REGION 1..20: note = Description of Artificial Sequence: Synthetic peptide
PEGREVVVCRDWYGVELCWQ

SEQ ID NO: 953 - protein, 20 aa, synthetic construct
  REGION 1..20: note = Description of Artificial Sequence: Synthetic peptide
IWGRTVVECQDWEGVELCWQ

SEQ ID NO: 954 - protein, 20 aa, synthetic construct
  REGION 1..20: note = Description of Artificial Sequence: Synthetic peptide
LALRKEVVCQEYYGVELCWI

SEQ ID NO: 955 - protein, 20 aa, synthetic construct
  REGION 1..20: note = Description of Artificial Sequence: Synthetic peptide
HEAREVVVCQDWYGVELCWQ

SEQ ID NO: 956 - protein, 20 aa, synthetic construct
  REGION 1..20: note = Description of Artificial Sequence: Synthetic peptide
MVNREVVVCEDWYGVELCWQ

SEQ ID NO: 957 - protein, 20 aa, synthetic construct
  REGION 1..20: note = Description of Artificial Sequence: Synthetic peptide
TANQTVVECQVWGGVELCWQ

SEQ ID NO: 958 - protein, 14 aa, synthetic construct
  REGION 1..14: note = Description of Artificial Sequence: Synthetic peptide
VECQEWGGVELCWC

SEQ ID NO: 959 - protein, 15 aa, synthetic construct
  REGION 1..15: note = Description of Artificial Sequence: Synthetic peptide
DVECVDWGGVELCWH

SEQ ID NO: 960 - protein, 14 aa, synthetic construct
  REGION 1..14: note = Description of Artificial Sequence: Synthetic peptide
IVCEEWRGVELCWL

SEQ ID NO: 961 - protein, 20 aa, synthetic construct
  REGION 1..20: note = Description of Artificial Sequence: Synthetic peptide
DFERSYVVCQDWDGVELCWI

SEQ ID NO: 962 - protein, 20 aa, synthetic construct
  REGION 1..20: note = Description of Artificial Sequence: Synthetic peptide
AHSRQEVVCEEWYGVELCWI

SEQ ID NO: 963 - protein, 20 aa, synthetic construct
  REGION 1..20: note = Description of Artificial Sequence: Synthetic peptide
SAPERWVECEDWQGVELCWV

SEQ ID NO: 964 - protein, 20 aa, synthetic construct
  REGION 1..20: note = Description of Artificial Sequence: Synthetic peptide
YSRELYVQCEDWEGVELCWI

SEQ ID NO: 965 - protein, 14 aa, synthetic construct
  REGION 1..14: note = Description of Artificial Sequence: Synthetic peptide
VVCQDWEGVELCWQ

SEQ ID NO: 966 - protein, 15 aa, synthetic construct
  REGION 1..15: note = Description of Artificial Sequence: Synthetic peptide
DVVCQNWEGVDLCWH

SEQ ID NO: 967 - protein, 20 aa, synthetic construct
  REGION 1..20: note = Description of Artificial Sequence: Synthetic peptide
SAGRQEVVCQDWNGVELCWI

SEQ ID NO: 968 - protein, 20 aa, synthetic construct
  REGION 1..20: note = Description of Artificial Sequence: Synthetic peptide
GQGREVVVCHDWYGVELCWQ

SEQ ID NO: 969 - protein, 20 aa, synthetic construct
  REGION 1..20: note = Description of Artificial Sequence: Synthetic peptide
DWRRSVVECQDWYGVELCWQ

SEQ ID NO: 970 - protein, 15 aa, synthetic construct
  REGION 1..15: note = Description of Artificial Sequence: Synthetic peptide
DVVCQNWDGVDLCWH

SEQ ID NO: 971 - protein, 20 aa, synthetic construct
  REGION 1..20: note = Description of Artificial Sequence: Synthetic peptide
TLGRTVVECQDWGGVELCWQ

SEQ ID NO: 972 - protein, 20 aa, synthetic construct
  REGION 1..20: note = Description of Artificial Sequence: Synthetic peptide
RLLNSVVECLDWEGVELCWQ

SEQ ID NO: 973 - protein, 14 aa, synthetic construct
  REGION 1..14: note = Description of Artificial Sequence: Synthetic peptide
IVCEDWRGVELCWI

SEQ ID NO: 974 - protein, 14 aa, synthetic construct
  REGION 1..14: note = Description of Artificial Sequence: Synthetic peptide
VVCQEWEGVELCWC

SEQ ID NO: 975 - protein, 20 aa, synthetic construct
  REGION 1..20: note = Description of Artificial Sequence: Synthetic peptide
GDRPKEVVCEDWKGVELCWI

SEQ ID NO: 976 - protein, 20 aa, synthetic construct
  REGION 1..20: note = Description of Artificial Sequence: Synthetic peptide
ERPRSFIECQEWEGVELCWL

SEQ ID NO: 977 - protein, 20 aa, synthetic construct
  REGION 1..20: note = Description of Artificial Sequence: Synthetic peptide
EGSTTTIECEEWAGVELCWL

SEQ ID NO: 978 - protein, 20 aa, synthetic construct
  REGION 1..20: note = Description of Artificial Sequence: Synthetic peptide
ANQNTVVECQDWHGVELCWQ

SEQ ID NO: 979 - protein, 20 aa, synthetic construct
  REGION 1..20: note = Description of Artificial Sequence: Synthetic peptide
RSDDEVVVCQEWEGVELCWQ

SEQ ID NO: 980 - protein, 14 aa, synthetic construct
  REGION 1..14: note = Description of Artificial Sequence: Synthetic peptide
IECEEWAGVELCWL

SEQ ID NO: 981 - protein, 20 aa, synthetic construct
  REGION 1..20: note = Description of Artificial Sequence: Synthetic peptide
TWNMSELECQDWNGVEICWH

SEQ ID NO: 982 - protein, 20 aa, synthetic construct
  REGION 1..20: note = Description of Artificial Sequence: Synthetic peptide
GNDDSYIVCEEWKGVELCWI

SEQ ID NO: 983 - protein, 20 aa, synthetic construct
  REGION 1..20: note = Description of Artificial Sequence: Synthetic peptide
FAHHGVVECQEWYGVELCWQ

SEQ ID NO: 984 - protein, 20 aa, synthetic construct
  REGION 1..20: note = Description of Artificial Sequence: Synthetic peptide
LNRSVWIECEEYEGVELCWL

SEQ ID NO: 985 - protein, 20 aa, synthetic construct
  REGION 1..20: note = Description of Artificial Sequence: Synthetic peptide
WSKKAEVVCEEWGGVEFCWI

SEQ ID NO: 986 - protein, 20 aa, synthetic construct
  REGION 1..20: note = Description of Artificial Sequence: Synthetic peptide
RSNQTVVECQDWEGVELCWQ

SEQ ID NO: 987 - protein, 20 aa, synthetic construct
  REGION 1..20: note = Description of Artificial Sequence: Synthetic peptide
VVCQEWEGVELCWYAGECMQ

SEQ ID NO: 988 - protein, 20 aa, synthetic construct
  REGION 1..20: note = Description of Artificial Sequence: Synthetic peptide
ILCQEFEGVELCWLEESLAE

SEQ ID NO: 989 - protein, 20 aa, synthetic construct
  REGION 1..20: note = Description of Artificial Sequence: Synthetic peptide
KSQVECQDWEGVELCWVVSE

SEQ ID NO: 990 - protein, 20 aa, synthetic construct
  REGION 1..20: note = Description of Artificial Sequence: Synthetic peptide
KITVECQDWDGVELCWPTWI

SEQ ID NO: 991 - protein, 20 aa, synthetic construct
  REGION 1..20: note = Description of Artificial Sequence: Synthetic peptide
RPQIECQEWQGVELCWTREE

SEQ ID NO: 992 - protein, 20 aa, synthetic construct
  REGION 1..20: note = Description of Artificial Sequence: Synthetic peptide
VSCQEWDGVELCWVDGDLAA

SEQ ID NO: 993 - protein, 20 aa, synthetic construct
  REGION 1..20: note = Description of Artificial Sequence: Synthetic peptide
IMCQEWDGVELCWLERDKAN

SEQ ID NO: 994 - protein, 20 aa, synthetic construct
  REGION 1..20: note = Description of Artificial Sequence: Synthetic peptide
GLEIACEDWYGVELCWLRRA

SEQ ID NO: 995 - protein, 24 aa, synthetic construct
  REGION 1..24: note = Description of Artificial Sequence: Synthetic peptide
GYGVLCQEWQGVELCWPVQREAGV

SEQ ID NO: 996 - protein, 20 aa, synthetic construct
  REGION 1..20: note = Description of Artificial Sequence: Synthetic peptide
PYGVVCQDWAGVELCWVENR

SEQ ID NO: 997 - protein, 20 aa, synthetic construct
  REGION 1..20: note = Description of Artificial Sequence: Synthetic peptide
KLTVECQDWDGVELCWVGVE

SEQ ID NO: 998 - protein, 20 aa, synthetic construct
  REGION 1..20: note = Description of Artificial Sequence: Synthetic peptide
INCQTWNGVELCWVDEGLYQ

SEQ ID NO: 999 - protein, 20 aa, synthetic construct
  REGION 1..20: note = Description of Artificial Sequence: Synthetic peptide
VVCQEWEGVELCWVEPPLLP

SEQ ID NO: 1000 - protein, 20 aa, synthetic construct
  REGION 1..20: note = Description of Artificial Sequence: Synthetic peptide
RVQVECEDWNGVELCWPVRV

SEQ ID NO: 1001 - protein, 20 aa, synthetic construct
  REGION 1..20: note = Description of Artificial Sequence: Synthetic peptide
DRQVVCEEWDGVELCWIEES

SEQ ID NO: 1002 - protein, 20 aa, synthetic construct
  REGION 1..20: note = Description of Artificial Sequence: Synthetic peptide
KTTVACQDWGGVELCWVERV

SEQ ID NO: 1003 - protein, 20 aa, synthetic construct
  REGION 1..20: note = Description of Artificial Sequence: Synthetic peptide
RPEVVCQEWEGVELCWISPL

SEQ ID NO: 1004 - protein, 20 aa, synthetic construct
  REGION 1..20: note = Description of Artificial Sequence: Synthetic peptide
RLGVECQEWEGVDLCWISAF

SEQ ID NO: 1005 - protein, 20 aa, synthetic construct
  REGION 1..20: note = Description of Artificial Sequence: Synthetic peptide
KPVVVCEEWQGVELCWLEIQ

SEQ ID NO: 1006 - protein, 20 aa, synthetic construct
  REGION 1..20: note = Description of Artificial Sequence: Synthetic peptide
VVCEVFQGVELCWCENEEFT

SEQ ID NO: 1007 - protein, 20 aa, synthetic construct
  REGION 1..20: note = Description of Artificial Sequence: Synthetic peptide
TDEVSCQEWEGVELCWIERQ

SEQ ID NO: 1008 - protein, 20 aa, synthetic construct
  REGION 1..20: note = Description of Artificial Sequence: Synthetic peptide
PVEVRCQEWEGVELCWVVGI

SEQ ID NO: 1009 - protein, 20 aa, synthetic construct
  REGION 1..20: note = Description of Artificial Sequence: Synthetic peptide
GPEVVCEEFNRVELCWVEYN

SEQ ID NO: 1010 - protein, 20 aa, synthetic construct
  REGION 1..20: note = Description of Artificial Sequence: Synthetic peptide
KYIVECQEWGGVELCWPEMV

SEQ ID NO: 1011 - protein, 20 aa, synthetic construct
  REGION 1..20: note = Description of Artificial Sequence: Synthetic peptide
VTCQEYEGVELCWTVGCAYS

SEQ ID NO: 1012 - protein, 21 aa, synthetic construct
  REGION 1..21: note = Description of Artificial Sequence: Synthetic peptide
VVCQEWEGVELCWQTGPGAHA

SEQ ID NO: 1013 - protein, 20 aa, synthetic construct
  REGION 1..20: note = Description of Artificial Sequence: Synthetic peptide
IVCEEYNGVELCWVETSVKP

SEQ ID NO: 1014 - protein, 20 aa, synthetic construct
  REGION 1..20: note = Description of Artificial Sequence: Synthetic peptide
EQQVVCQEWNGVELCWIEAG

SEQ ID NO: 1015 - protein, 20 aa, synthetic construct
  REGION 1..20: note = Description of Artificial Sequence: Synthetic peptide
QLGVECQNWRGVELCWVSEI

SEQ ID NO: 1016 - protein, 20 aa, synthetic construct
  REGION 1..20: note = Description of Artificial Sequence: Synthetic peptide
TAEVVCQEWDGVELCWIEVL

SEQ ID NO: 1017 - protein, 20 aa, synthetic construct
  REGION 1..20: note = Description of Artificial Sequence: Synthetic peptide
SPSIVCEEWAGVELCWVDYS

SEQ ID NO: 1018 - protein, 20 aa, synthetic construct
  REGION 1..20: note = Description of Artificial Sequence: Synthetic peptide
AVCQDWYGVELCWCMQDILD

SEQ ID NO: 1019 - protein, 20 aa, synthetic construct
  REGION 1..20: note = Description of Artificial Sequence: Synthetic peptide
VECEEWGGVELCWLADEVMW

SEQ ID NO: 1020 - protein, 20 aa, synthetic construct
  REGION 1..20: note = Description of Artificial Sequence: Synthetic peptide
HSTVICQDWDGVELCWIEND

SEQ ID NO: 1021 - protein, 20 aa, synthetic construct
  REGION 1..20: note = Description of Artificial Sequence: Synthetic peptide
KKIVVCQDWGGVELCWTEDD

SEQ ID NO: 1022 - protein, 20 aa, synthetic construct
  REGION 1..20: note = Description of Artificial Sequence: Synthetic peptide
SVEVVCEEWHGVELCWPVFI

SEQ ID NO: 1023 - protein, 20 aa, synthetic construct
  REGION 1..20: note = Description of Artificial Sequence: Synthetic peptide
RWAVSCQDWQGIELCWPEWD

SEQ ID NO: 1024 - protein, 20 aa, synthetic construct
  REGION 1..20: note = Description of Artificial Sequence: Synthetic peptide
RTGVECQDWHGVELCWPVWE

SEQ ID NO: 1025 - protein, 20 aa, synthetic construct
  REGION 1..20: note = Description of Artificial Sequence: Synthetic peptide
GYGVVCEDFRGVELCWLERK

SEQ ID NO: 1026 - protein, 17 aa, synthetic construct
  REGION 1..17: note = Description of Artificial Sequence: Synthetic peptide
RTEVECEDWEGVELCWL

SEQ ID NO: 1027 - protein, 19 aa, synthetic construct
  REGION 1..19: note = Description of Artificial Sequence: Synthetic peptide
ILCEEWQGVELCWLEGGGS

SEQ ID NO: 1028 - protein, 16 aa, synthetic construct
  REGION 1..16: note = Description of Artificial Sequence: Synthetic peptide
VGIECEEWAGVELCWL

SEQ ID NO: 1029 - protein, 16 aa, synthetic construct
  REGION 1..16: note = Description of Artificial Sequence: Synthetic peptide
VVCQDWEGVELCWQGG

SEQ ID NO: 1030 - protein, 16 aa, synthetic construct
  REGION 1..16: note = Description of Artificial Sequence: Synthetic peptide
GGVVCQDWEGVELCWQ

SEQ ID NO: 1031 - protein, 18 aa, synthetic construct
  REGION 1..18: note = Description of Artificial Sequence: Synthetic peptide
GGVVCQDWEGVELCWQGG

SEQ ID NO: 1032 - protein, 18 aa, synthetic construct
  REGION 1..18: note = Description of Artificial Sequence: Synthetic peptide
GGVVCADWEGVELCWQGG

SEQ ID NO: 1033 - protein, 18 aa, synthetic construct
  REGION 1..18: note = Description of Artificial Sequence: Synthetic peptide
GGVVCQAWEGVELCWQGG

SEQ ID NO: 1034 - protein, 18 aa, synthetic construct
  REGION 1..18: note = Description of Artificial Sequence: Synthetic peptide
GGVVCQDAEGVELCWQGG

SEQ ID NO: 1035 - protein, 18 aa, synthetic construct
  REGION 1..18: note = Description of Artificial Sequence: Synthetic peptide
GGVVCQDWAGVELCWQGG

SEQ ID NO: 1036 - protein, 18 aa, synthetic construct
  REGION 1..18: note = Description of Artificial Sequence: Synthetic peptide
GGVVCQDWEAVELCWQGG

SEQ ID NO: 1037 - protein, 18 aa, synthetic construct
  REGION 1..18: note = Description of Artificial Sequence: Synthetic peptide
GGVVCQDWEGAELCWQGG

SEQ ID NO: 1038 - protein, 18 aa, synthetic construct
  REGION 1..18: note = Description of Artificial Sequence: Synthetic peptide
GGVVCQDWEGVALCWQGG

SEQ ID NO: 1039 - protein, 18 aa, synthetic construct
  REGION 1..18: note = Description of Artificial Sequence: Synthetic peptide
GGVVCQDWEGVEACWQGG

SEQ ID NO: 1040 - protein, 19 aa, synthetic construct
  REGION 1..19: note = Description of Artificial Sequence: Synthetic peptide
GGVVCQDWEGVELCWQGGR

SEQ ID NO: 1041-1099 - skipped (59 entries)

SEQ ID NO: 1100 - protein, 20 aa, synthetic construct
  REGION 1..20: note = Description of Artificial Sequence: Synthetic peptide
MGFYPCWTAQLGELCDLSVD

SEQ ID NO: 1101 - protein, 19 aa, synthetic construct
  REGION 1..19: note = Description of Artificial Sequence: Synthetic peptide
GFYPCWTAQLGELCDLSVD

SEQ ID NO: 1102 - protein, 18 aa, synthetic construct
  REGION 1..18: note = Description of Artificial Sequence: Synthetic peptide
FYPCWTAQLGELCDLSVD

SEQ ID NO: 1103 - protein, 17 aa, synthetic construct
  REGION 1..17: note = Description of Artificial Sequence: Synthetic peptide
YPCWTAQLGELCDLSVD

SEQ ID NO: 1104 - protein, 19 aa, synthetic construct
  REGION 1..19: note = Description of Artificial Sequence: Synthetic peptide
MGFYPCWTAQLGELCDLSV

SEQ ID NO: 1105 - protein, 18 aa, synthetic construct
  REGION 1..18: note = Description of Artificial Sequence: Synthetic peptide
MGFYPCWTAQLGELCDLS

SEQ ID NO: 1106 - protein, 17 aa, synthetic construct
  REGION 1..17: note = Description of Artificial Sequence: Synthetic peptide
MGFYPCWTAQLGELCDL

SEQ ID NO: 1107 - protein, 18 aa, synthetic construct
  REGION 1..18: note = Description of Artificial Sequence: Synthetic peptide
GFYPCWTAQLGELCDLSV

SEQ ID NO: 1108 - protein, 15 aa, synthetic construct
  REGION 1..15: note = Description of Artificial Sequence: Synthetic peptide
FYPCWTAQLGELCDL

SEQ ID NO: 1109 - skipped

SEQ ID NO: 1110 - protein, 14 aa, synthetic construct
  REGION 1..14: note = Description of Artificial Sequence: Synthetic peptide
KYCGFAQLGELCVL

SEQ ID NO: 1111 - protein, 15 aa, synthetic construct
  REGION 1..15: note = Description of Artificial Sequence: Synthetic peptide
GKYCGFAQLGELCVL

SEQ ID NO: 1112 - protein, 16 aa, synthetic construct
  REGION 1..16: note = Description of Artificial Sequence: Synthetic peptide
GGKYCGFAQLGELCVL

SEQ ID NO: 1113 - protein, 17 aa, synthetic construct
  REGION 1..17: note = Description of Artificial Sequence: Synthetic peptide
GGGKYCGFAQLGELCVL

SEQ ID NO: 1114 - protein, 15 aa, synthetic construct
  REGION 1..15: note = Description of Artificial Sequence: Synthetic peptide
KYCGFAQLGELCVLG

SEQ ID NO: 1115 - protein, 16 aa, synthetic construct
  REGION 1..16: note = Description of Artificial Sequence: Synthetic peptide
KYCGFAQLGELCVLGG

SEQ ID NO: 1116 - protein, 17 aa, synthetic construct
  REGION 1..17: note = Description of Artificial Sequence: Synthetic peptide
KYCGFAQLGELCVLGGG

SEQ ID NO: 1117 - protein, 16 aa, synthetic construct
  REGION 1..16: note = Description of Artificial Sequence: Synthetic peptide
GKYCGFAQLGELCVLG

SEQ ID NO: 1118 - protein, 17 aa, synthetic construct
  REGION 1..17: note = Description of Artificial Sequence: Synthetic peptide
GGKYCGFAQLGELCVLG

SEQ ID NO: 1119 - skipped

SEQ ID NO: 1120 - protein, 14 aa, synthetic construct
  REGION 1..14: note = Description of Artificial Sequence: Synthetic peptide
YWCWMAQVGELCDL

SEQ ID NO: 1121 - protein, 14 aa, synthetic construct
  REGION 1..14: note = Description of Artificial Sequence: Synthetic peptide
YHCWMAQVGELCDL

SEQ ID NO: 1122 - protein, 14 aa, synthetic construct
  REGION 1..14: note = Description of Artificial Sequence: Synthetic peptide
YHCWMGQVGELCDL

SEQ ID NO: 1123 - protein, 14 aa, synthetic construct
  REGION 1..14: note = Description of Artificial Sequence: Synthetic peptide
YHCWMGQMGELCDL

SEQ ID NO: 1124 - protein, 14 aa, synthetic construct
  REGION 1..14: note = Description of Artificial Sequence: Synthetic peptide
YHCWMGQMGELCEL

SEQ ID NO: 1125 - protein, 14 aa, synthetic construct
  REGION 1..14: note = Description of Artificial Sequence: Synthetic peptide
YHCWMGQMGELCEM

SEQ ID NO: 1126-1129 - skipped (4 entries)

SEQ ID NO: 1130 - protein, 20 aa, synthetic construct
  REGION 1..20: note = Description of Artificial Sequence: Synthetic peptide
YPCWLARVGELCDLDSGDVH

SEQ ID NO: 1131 - protein, 20 aa, synthetic construct
  REGION 1..20: note = Description of Artificial Sequence: Synthetic peptide
APCWLARVGELCDLDSGDVH

SEQ ID NO: 1132 - protein, 20 aa, synthetic construct
  REGION 1..20: note = Description of Artificial Sequence: Synthetic peptide
APCALARVGELCDLDSGDVH

SEQ ID NO: 1133 - protein, 20 aa, synthetic construct
  REGION 1..20: note = Description of Artificial Sequence: Synthetic peptide
APCALAAVGELCDLDSGDVH

SEQ ID NO: 1134 - protein, 20 aa, synthetic construct
  REGION 1..20: note = Description of Artificial Sequence: Synthetic peptide
APCALAAVGALCDLDSGDVH

SEQ ID NO: 1135 - protein, 20 aa, synthetic construct
  REGION 1..20: note = Description of Artificial Sequence: Synthetic peptide
APCALAAVGALCDLASGDVH

SEQ ID NO: 1136 - protein, 20 aa, synthetic construct
  REGION 1..20: note = Description of Artificial Sequence: Synthetic peptide
APCALAAVGALCDLAAGDVH

SEQ ID NO: 1137-1210 - skipped (74 entries)

SEQ ID NO: 1211 - protein, 233 aa, synthetic construct
  REGION 1..233: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGART

SEQ ID NO: 1212 - protein, 300 aa, synthetic construct
  REGION 1..300: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGSGSGSGSGSGSGSGSGSGSGGVHRIPWCTLDPGGLQCAWLRQMGGGGSGGVVCQDWEGVELCWQGG

SEQ ID NO: 1213 - protein, 292 aa, synthetic construct
  REGION 1..292: note = Description of Artificial Sequence: Synthetic polypeptide
AEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGARTGGGGSGGGGSGGVHRIPWCTLDPGGLQCAWLRQMGGGGSGGVVCQDWEGVELCWQGG

SEQ ID NO: 1214 - protein, 284 aa, synthetic construct
  REGION 1..284: note = Description of Artificial Sequence: Synthetic polypeptide
APPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLGSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGARTGGGGSGGGGSGGVHRIPWCTLDPGGLQCAWLRQMGGGGSGGVVCQDWEGVELCWQGG

SEQ ID NO: 1215 - protein, 289 aa, synthetic construct
  REGION 1..289: note = Description of Artificial Sequence: Synthetic polypeptide
GGVHRIPWCTLDPGGLQCAWLRQMGGGGSGGVVCQDWEGVELCWQGGGGSGGGGSGGGGSRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1216 - protein, 298 aa, synthetic construct
  REGION 1..298: note = Description of Artificial Sequence: Synthetic polypeptide
GITVAEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGVHRIPWCTLDPGGLQCAWLRQMGGGGSGGVVCQDWEGVELCWQGG

SEQ ID NO: 1217 - protein, 231 aa, synthetic construct
  REGION 1..231: note = Description of Artificial Sequence: Synthetic polypeptide
EPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 1218 - protein, 218 aa, synthetic construct
  REGION 1..218: note = Description of Artificial Sequence: Synthetic polypeptide
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1219 - protein, 514 aa, synthetic construct
  REGION 1..514: note = Description of Artificial Sequence: Synthetic polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGAGSGSGSGSGSGSGSGSGSGSGGVHRIPWCTLDPGGLQCAWLRQMGGGGSGGVVCQDWEGVELCWQGG

SEQ ID NO: 1220-1223 - skipped (4 entries)

SEQ ID NO: 1224 - protein, 294 aa, synthetic construct
  REGION 1..294: note = Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAGSGSGSGSGSGSGSGSGSGSGGVHRIPWCTLDPGGLQCAWLRQMGGGGSGGVVCQDWEGVELCWQGG

SEQ ID NO: 1225 - protein, 295 aa, synthetic construct
  REGION 1..295: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGAGSGSGSGSGSGSGSGSGSGSGGVHRIPWCTLDPGGLQCAWLRQMGGGGSGGVVCQDWEGVELCWQGG

SEQ ID NO: 1226 - protein, 295 aa, synthetic construct
  REGION 1..295: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGAPAPAPAPAPAPAPAPAPAPAGGVHRIPWCTLDPGGLQCAWLRQMGGGGSGGVVCQDWEGVELCWQGG

SEQ ID NO: 1227 - protein, 285 aa, synthetic construct
  REGION 1..285: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGVHRIPWCTLDPGGLQCAWLRQMGGGGSGGVVCQDWEGVELCWQGG

SEQ ID NO: 1228 - protein, 295 aa, synthetic construct
  REGION 1..295: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGGGSGGVHRIPWCTLDPGGLQCAWLRQMGGGGSGGVVCQDWEGVELCWQGG

SEQ ID NO: 1229 - protein, 300 aa, synthetic construct
  REGION 1..300: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGGGSGGGGSGGVHRIPWCTLDPGGLQCAWLRQMGGGGSGGVVCQDWEGVELCWQGG

SEQ ID NO: 1230 - protein, 282 aa, synthetic construct
  REGION 1..282: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGVHRIPWCTLDPGGLQCAWLRQMGGGGSGGVVCQDWEGVELCWQGG

SEQ ID NO: 1231 - protein, 285 aa, synthetic construct
  REGION 1..285: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGGGGVHRIPWCTLDPGGLQCAWLRQMGGGGSGGVVCQDWEGVELCWQGG

SEQ ID NO: 1232 - protein, 300 aa, synthetic construct; identical to SEQ ID NO: 1212
  REGION 1..300: note = Description of Artificial Sequence: Synthetic polypeptide

SEQ ID NO: 1233 - protein, 290 aa, synthetic construct
  REGION 1..290: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAGGVHRIPWCTLDPGGLQCAWLRQMGGGGSGGVVCQDWEGVELCWQGG

SEQ ID NO: 1234 - protein, 300 aa, synthetic construct
  REGION 1..300: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAPAPAPAPAPAGGVHRIPWCTLDPGGLQCAWLRQMGGGGSGGVVCQDWEGVELCWQGG

SEQ ID NO: 1235 - protein, 294 aa, synthetic construct
  REGION 1..294: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAPAPAGGVHRIPWCTLDPGGLQCAWLRQMGGGGSGGVVCQDWEGVELCWQGG

SEQ ID NO: 1236-1251 - skipped (16 entries)

SEQ ID NO: 1252 - protein, 654 aa, synthetic construct
  REGION 1..654: note = Description of Artificial Sequence: Synthetic polypeptide
GGHHHHHHGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLRTGGGGSGGGGSGGVHRIPWCTLDPGGLQCAWLRQMGGGGSGGVVCQDWEGVELCWQGG

SEQ ID NO: 1253 - protein, 286 aa, synthetic construct
  REGION 1..286: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSIEGRGGQCIHWDIETLLSCVGGGGSGGVVCQDWEGVELCWQGG

SEQ ID NO: 1254 - protein, 288 aa, synthetic construct
  REGION 1..288: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSIEGRGGVPWCTLDPGSLQCAWFGGGGSGGVVCQDWEGVELCWQGG

SEQ ID NO: 1255 - protein, 288 aa, synthetic construct
  REGION 1..288: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSIEGRGGRYECADLPGGLHCEFRGGGGSGGVVCQDWEGVELCWQGG

SEQ ID NO: 1256 - protein, 290 aa, synthetic construct
  REGION 1..290: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGRHFDDIIPWCTLDPGSLQCAYLGGGGSGGVVCQDWEGVELCWQGG

SEQ ID NO: 1257 - protein, 290 aa, synthetic construct
  REGION 1..290: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGHLGVPWCTLDPGSIQCAWLAKHGGGGSGGVVCQDWEGVELCWQGG

SEQ ID NO: 1258 - protein, 290 aa, synthetic construct
  REGION 1..290: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGVVCQDWEGVELCWQGGGGSGGRHFDDIIPWCTLDPGSLQCAYLGG

SEQ ID NO: 1259 - protein, 290 aa, synthetic construct
  REGION 1..290: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGVVCQDWEGVELCWQGGGGSGGHLGVPWCTLDPGSIQCAWLAKHGG

SEQ ID NO: 1260 - protein, 292 aa, synthetic construct
  REGION 1..292: note = Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGSGSGSGSGSGSGSGSGSGSGGHCKHWDLESLLLCVGGGGSGGVVCQDWEGVELCWQGG

SEQ ID NO: 1261 - protein, 293 aa, synthetic construct
  REGION 1..293: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGQCVHWDLDTLFGCIREQLELGGGGSGGVVCQDWEGVELCWQGG

SEQ ID NO: 1262 - protein, 293 aa, synthetic construct
  REGION 1..293: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGVVCQDWEGVELCWQGGGGSGGQCVHWDLDTLFGCIREQLELGG

SEQ ID NO: 1263 - protein, 295 aa, synthetic construct
  REGION 1..295: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGIRSCLWQPGALHCTWWAEEEPVGGGGSGGVVCQDWEGVELCWQGG

SEQ ID NO: 1264 - protein, 295 aa, synthetic construct
  REGION 1..295: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGVVCQDWEGVELCWQGGGGSGGIRSCLWQPGALHCTWWAEEEPVGG

SEQ ID NO: 1265 - protein, 289 aa, synthetic construct
  REGION 1..289: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGIPWCLLDPGGLQCVWLGGGGSGGVVCQDWEGVELCWQGG

SEQ ID NO: 1266 - protein, 289 aa, synthetic construct
  REGION 1..289: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGVVCQDWEGVELCWQGGGGSGGIPWCLLDPGGLQCVWLGG

SEQ ID NO: 1267 - protein, 293 aa, synthetic construct
  REGION 1..293: note = Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGGSGSGSGSGSGSGSGSGSGSGGVHRIPWCTLDPGGLQCAWLRQMGGGGSGGVVCQDWEGVELCWQGG

SEQ ID NO: 1268 - protein, 301 aa, synthetic construct
  REGION 1..301: note = Description of Artificial Sequence: Synthetic polypeptide
AKTEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGGSGSGSGSGSGSGSGSGSGSGGVHRIPWCTLDPGGLQCAWLRQMGGGGSGGVVCQDWEGVELCWQGG

SEQ ID NO: 1269 - protein, 293 aa, synthetic construct
  REGION 1..293: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGVHRIPWCTLDPGGLQCAWLRGGGGSGGVVCQDWEGVELCWQGG

SEQ ID NO: 1270 - protein, 295 aa, synthetic construct
  REGION 1..295: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGGWGIPWCTLDPGSLQCAWLGKHGGGGSGGVVCQDWEGVELCWQGG

SEQ ID NO: 1271 - protein, 294 aa, synthetic construct
  REGION 1..294: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGVHRIPWCTLDPGGLQCAWLRQGGGGSGGVVCQDWEGVELCWQGG

SEQ ID NO: 1272 - protein, 294 aa, synthetic construct
  REGION 1..294: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGVHRIPWCTLDPGGLQCAWLRMGGGGSGGVVCQDWEGVELCWQGG

SEQ ID NO: 1273 - protein, 295 aa, synthetic construct
  REGION 1..295: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGVHRIPWCTLDPGGLQCAWIRQMGGGGSGGVVCQDWEGVELCWQGG

SEQ ID NO: 1274 - protein, 295 aa, synthetic construct
  REGION 1..295: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGVHRIPWCTLDPGGLQCAWVRQMGGGGSGGVVCQDWEGVELCWQGG

SEQ ID NO: 1275 - protein, 295 aa, synthetic construct
  REGION 1..295: note = Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGVHRIPWCTLDPGGLQCAWARQMGGGGSGGVVCQDWEGVELCWQGG

SEQ ID NO: 1276-2011 - skipped (736 entries)

SEQ ID NO: 2012 - protein, 43 aa, synthetic construct
  REGION 1..43: note = Description of Artificial Sequence: Synthetic polypeptide
VHRIPWCTLDPGGLQCAWLRQMGGGGSGGVVCQDWEGVELCWQ

SEQ ID NO: 2013 - protein, 41 aa, synthetic construct
  REGION 1..41: note = Description of Artificial Sequence: Synthetic polypeptide
VHRIPWCTLDPGGLQCAWLRQGGGGSGGVVCQDEGVELCWQ

SEQ ID NO: 2014 - protein, 40 aa, synthetic construct
  REGION 1..40: note = Description of Artificial Sequence: Synthetic polypeptide
VHRIPWCTLDPGGLQCAWLRGGGGSGGVVCQDWGVELCWQ

SEQ ID NO: 2015 - protein, 41 aa, synthetic construct
  REGION 1..41: note = Description of Artificial Sequence: Synthetic polypeptide
HRIPWCTLDPGGLQCAWLRQMGGGGSGGVVCQWEGVELCWQ

SEQ ID NO: 2016 - protein, 32 aa, synthetic construct
  REGION 1..32: note = Description of Artificial Sequence: Synthetic polypeptide
HRIPWCTLDPGGLQCAWLRQGGGGSGGVVCQD

SEQ ID NO: 2017 - protein, 39 aa, synthetic construct
  REGION 1..39: note = Description of Artificial Sequence: Synthetic polypeptide
HRIPWCTLDPGGLQCAWLRGGGGSGGVVCQDWGVELCWQ

SEQ ID NO: 2018 - protein, 40 aa, synthetic construct
  REGION 1..40: note = Description of Artificial Sequence: Synthetic polypeptide
RIPWCTLDPGGLQCAWLRQMGGGGSGGVVCQWEGVELCWQ

SEQ ID NO: 2019 - protein, 39 aa, synthetic construct
  REGION 1..39: note = Description of Artificial Sequence: Synthetic polypeptide
RIPWCTLDPGGLQCAWLRQGGGGSGGVVCQDEGVELCWQ

SEQ ID NO: 2020 - protein, 40 aa, synthetic construct
  REGION 1..40: note = Description of Artificial Sequence: Synthetic polypeptide
RIPWCTLDPGGLQCAWLRGGGGSGGVVCQDWWEGVELCWQ

SEQ ID NO: 2021 - protein, 39 aa, synthetic construct
  REGION 1..39: note = Description of Artificial Sequence: Synthetic polypeptide
IPWCTLDPGGLQCAWLRQMGGGGSGGVVCQWEGVELCWQ

SEQ ID NO: 2022 - protein, 38 aa, synthetic construct
  REGION 1..38: note = Description of Artificial Sequence: Synthetic polypeptide
IPWCTLDPGGLQCAWLRQGGGGSGGVVCQDEGVELCWQ

SEQ ID NO: 2023 - protein, 37 aa, synthetic construct
  REGION 1..37: note = Description of Artificial Sequence: Synthetic polypeptide
IPWCTLDPGGLQCAWLRGGGGSGGVVCQDWGVELCWQ

SEQ ID NO: 2024-2044 - skipped (21 entries)

SEQ ID NO: 2045 - protein, 4 aa, synthetic construct
  REGION 1..4: note = Description of Artificial Sequence: Synthetic peptide
GGGG

SEQ ID NO: 2046-2057 - skipped (12 entries)

SEQ ID NO: 2058 - protein, 58 aa, synthetic construct
  REGION 1..58: note = Description of Artificial Sequence: Synthetic polypeptide
  VARIANT 23..42: note = Any amino acid
  SITE 23..42: note = This region may emcompass 1-20 residues
VHRIPWCTLDPGGLQCAWLRQMXXXXXXXXXXXXXXXXXXXXGGVVCQDWEGVELCWQ

SEQ ID NO: 2059 - protein, 56 aa, synthetic construct
  REGION 1..56: note = Description of Artificial Sequence: Synthetic polypeptide
  VARIANT 23..42: note = Any amino acid
  SITE 23..42: note = This region may emcompass 1-20 residues
VHRIPWCTLDPGGLQCAWLRQMXXXXXXXXXXXXXXXXXXXXVVCQDWEGVELCWQ

SEQ ID NO: 2060 - protein, 41 aa, synthetic construct
  REGION 1..41: note = Description of Artificial Sequence: Synthetic polypeptide
IEGRGGQCIHWDIETLLSCVGGGGSGGVVCQDWEGVELCWQ

SEQ ID NO: 2061 - protein, 43 aa, synthetic construct
  REGION 1..43: note = Description of Artificial Sequence: Synthetic polypeptide
IEGRGGVPWCTLDPGSLQCAWFGGGGSGGVVCQDWEGVELCWQ

SEQ ID NO: 2062 - protein, 43 aa, synthetic construct
  REGION 1..43: note = Description of Artificial Sequence: Synthetic polypeptide
IEGRGGRYECADLPGGLHCEFRGGGGSGGVVCQDWEGVELCWQ

SEQ ID NO: 2063 - protein, 43 aa, synthetic construct
  REGION 1..43: note = Description of Artificial Sequence: Synthetic polypeptide
RHFDDIIPWCTLDPGSLQCAYLGGGGSGGVVCQDWEGVELCWQ

SEQ ID NO: 2064 - protein, 46 aa, synthetic construct
  REGION 1..46: note = Description of Artificial Sequence: Synthetic polypeptide
VHRIPWCTLDPGGLQCAWLRQMGGGGSGGVVCQDWEGVELCWQPPA

SEQ ID NO: 2065 - protein, 45 aa, synthetic construct
  REGION 1..45: note = Description of Artificial Sequence: Synthetic polypeptide
VHRIPWCTLDPGGLQCAWLRQGGGGSGGVVCQDWEGVELCWQPPA

SEQ ID NO: 2066 - protein, 44 aa, synthetic construct
  REGION 1..44: note = Description of Artificial Sequence: Synthetic polypeptide
VHRIPWCTLDPGGLQCAWLRGGGGSGGVVCQDWEGVELCWQPPA

SEQ ID NO: 2067 - protein, 46 aa, synthetic construct
  REGION 1..46: note = Description of Artificial Sequence: Synthetic polypeptide
GWGIPWCTLDPGSLQCAWLGKHGGGGSGGVVCQDWEGVELCWQPPA

SEQ ID NO: 2068 - protein, 46 aa, synthetic construct
  REGION 1..46: note = Description of Artificial Sequence: Synthetic polypeptide
VHRIPWCTLDPGGLQCAWLRQGGGGGSGGVVCQDWEGVELCWQPPA

SEQ ID NO: 2069 - protein, 46 aa, synthetic construct
  REGION 1..46: note = Description of Artificial Sequence: Synthetic polypeptide
VHRIPWCTLDPGGLQCAWLRGGGGGGSGGVVCQDWEGVELCWQPPA

SEQ ID NO: 2070 - protein, 44 aa, synthetic construct
  REGION 1..44: note = Description of Artificial Sequence: Synthetic polypeptide
VHRIPWCTLDPGGLQCAWLRQGGGGSGGVVCQDWEGVELCWQGG

SEQ ID NO: 2071 - protein, 43 aa, synthetic construct
  REGION 1..43: note = Description of Artificial Sequence: Synthetic polypeptide
VHRIPWCTLDPGGLQCAWLRGGGGSGGVVCQDWEGVELCWQGG

SEQ ID NO: 2072 - protein, 45 aa, synthetic construct
  REGION 1..45: note = Description of Artificial Sequence: Synthetic polypeptide
GWGIPWCTLDPGSLQCAWLGKHGGGGSGGVVCQDWEGVELCWQGG

SEQ ID NO: 2073 - protein, 55 aa, synthetic construct
  REGION 1..55: note = Description of Artificial Sequence: Synthetic polypeptide
VHRIPWCTLDPGGLQCAWLRQMPAPAPAPAPAPAPAPAGVVCQDWEGVELCWQGG

SEQ ID NO: 2074 - protein, 43 aa, synthetic construct
  REGION 1..43: note = Description of Artificial Sequence: Synthetic polypeptide
HLGVPWCTLDPGSIQCAWLAKHGGGGSGGVVCQDWEGVELCWQ

SEQ ID NO: 2075 - protein, 43 aa, synthetic construct
  REGION 1..43: note = Description of Artificial Sequence: Synthetic polypeptide
VVCQDWEGVELCWQGGGGSGGRHFDDIIPWCTLDPGSLQCAYL

SEQ ID NO: 2076 - protein, 43 aa, synthetic construct
  REGION 1..43: note = Description of Artificial Sequence: Synthetic polypeptide
VVCQDWEGVELCWQGGGGSGGHLGVPWCTLDPGSIQCAWLAKH

SEQ ID NO: 2077 - protein, 35 aa, synthetic construct
  REGION 1..35: note = Description of Artificial Sequence: Synthetic polypeptide
HCKHWDLESLLLCVGGGGSGGVVCQDWEGVELCWQ

SEQ ID NO: 2078 - protein, 41 aa, synthetic construct
  REGION 1..41: note = Description of Artificial Sequence: Synthetic polypeptide
QCVHWDLDTLFGCIREQLELGGGGSGGVVCQDWEGVELCWQ

SEQ ID NO: 2079 - protein, 41 aa, synthetic construct
  REGION 1..41: note = Description of Artificial Sequence: Synthetic polypeptide
VVCQDWEGVELCWQGGGGSGGQCVHWDLDTLFGCIREQLEL

SEQ ID NO: 2080 - protein, 43 aa, synthetic construct
  REGION 1..43: note = Description of Artificial Sequence: Synthetic polypeptide
IRSCLWQPGALHCTWWAEEEPVGGGGSGGVVCQDWEGVELCWQ

SEQ ID NO: 2081 - protein, 43 aa, synthetic construct
  REGION 1..43: note = Description of Artificial Sequence: Synthetic polypeptide
VVCQDWEGVELCWQGGGGSGGIRSCLWQPGALHCTWWAEEEPV

SEQ ID NO: 2082 - protein, 37 aa, synthetic construct
  REGION 1..37: note = Description of Artificial Sequence: Synthetic polypeptide
IPWCLLDPGGLQCVWLGGGGSGGVVCQDWEGVELCWQ

SEQ ID NO: 2083 - protein, 37 aa, synthetic construct
  REGION 1..37: note = Description of Artificial Sequence: Synthetic polypeptide
VVCQDWEGVELCWQGGGGSGGIPWCLLDPGGLQCVWL

SEQ ID NO: 2084 - protein, 44 aa, synthetic construct
  REGION 1..44: note = Description of Artificial Sequence: Synthetic polypeptide
VHRIPWCTLDPGGLQCAWLRQMGGGGSGGVVCQDWEGVELCWQG

SEQ ID NO: 2085 - protein, 45 aa, synthetic construct
  REGION 1..45: note = Description of Artificial Sequence: Synthetic polypeptide
VHRIPWCTLDPGGLQCAWLRQMGGGGSGGVVCQDWEGVELCWQGG

SEQ ID NO: 2086 - protein, 46 aa, synthetic construct
  REGION 1..46: note = Description of Artificial Sequence: Synthetic polypeptide
GVHRIPWCTLDPGGLQCAWLRQMGGGGSGGVVCQDWEGVELCWQGG

SEQ ID NO: 2087 - protein, 47 aa, synthetic construct
  REGION 1..47: note = Description of Artificial Sequence: Synthetic polypeptide
GGVHRIPWCTLDPGGLQCAWLRQMGGGGSGGVVCQDWEGVELCWQGG

SEQ ID NO: 2088 - protein, 41 aa, synthetic construct
  REGION 1..41: note = Description of Artificial Sequence: Synthetic polypeptide
VHRIPWCTLDPGGLQCAWLRGGGGSGGVVCQDWEGVELCWQ

SEQ ID NO: 2089 - protein, 42 aa, synthetic construct
  REGION 1..42: note = Description of Artificial Sequence: Synthetic polypeptide
WGIPWCTLDPGSLQCAWLGKHGGGGSGGVVCQDWEGVELCWQ

SEQ ID NO: 2090 - protein, 42 aa, synthetic construct
  REGION 1..42: note = Description of Artificial Sequence: Synthetic polypeptide
VHRIPWCTLDPGGLQCAWLRQGGGGSGGVVCQDWEGVELCWQ

SEQ ID NO: 2091 - protein, 42 aa, synthetic construct
  REGION 1..42: note = Description of Artificial Sequence: Synthetic polypeptide
VHRIPWCTLDPGGLQCAWLRMGGGGSGGVVCQDWEGVELCWQ

SEQ ID NO: 2092 - protein, 43 aa, synthetic construct
  REGION 1..43: note = Description of Artificial Sequence: Synthetic polypeptide
VHRIPWCTLDPGGLQCAWIRQMGGGGSGGVVCQDWEGVELCWQ

SEQ ID NO: 2093 - protein, 43 aa, synthetic construct
  REGION 1..43: note = Description of Artificial Sequence: Synthetic polypeptide
VHRIPWCTLDPGGLQCAWVRQMGGGGSGGVVCQDWEGVELCWQ

SEQ ID NO: 2094 - protein, 43 aa, synthetic construct
  REGION 1..43: note = Description of Artificial Sequence: Synthetic polypeptide
VHRIPWCTLDPGGLQCAWARQMGGGGSGGVVCQDWEGVELCWQ

SEQ ID NO: 2095 - protein, 45 aa, synthetic construct
  REGION 1..45: note = Description of Artificial Sequence: Synthetic polypeptide
GVHRIPWCTLDPGGLQCAWLRQMGGGGSGGVVCQDWEGVELCWQG

SEQ ID NO: 2096 - protein, 41 aa, synthetic construct; identical to SEQ ID NO: 2013
  REGION 1..41: note = Description of Artificial Sequence: Synthetic polypeptide

SEQ ID NO: 2097 - protein, 40 aa, synthetic construct; identical to SEQ ID NO: 2014
  REGION 1..40: note = Description of Artificial Sequence: Synthetic polypeptide

SEQ ID NO: 2098 - protein, 42 aa, synthetic construct
  REGION 1..42: note = Description of Artificial Sequence: Synthetic polypeptide
VHRIPWCTLDPGGLQCAWLGKHGGGGSGGVVCQWEGVELCWQ

SEQ ID NO: 2099 - protein, 41 aa, synthetic construct
  REGION 1..41: note = Description of Artificial Sequence: Synthetic polypeptide
VHRIPWCTLDPGGLQCAWLRMGGGGSGGVVCQDWGVELCWQ

SEQ ID NO: 2100 - protein, 43 aa, synthetic construct
  REGION 1..43: note = Description of Artificial Sequence: Synthetic polypeptide
GWGIPWCTLDPGGLQCAWLRQMGGGGSGGVVCQDWEGVELCWQ

SEQ ID NO: 2101 - protein, 41 aa, synthetic construct
  REGION 1..41: note = Description of Artificial Sequence: Synthetic polypeptide
GWGIPWCTLDPGGLQCAWLRQGGGGSGGVVCQDEGVELCWQ

SEQ ID NO: 2102 - protein, 40 aa, synthetic construct
  REGION 1..40: note = Description of Artificial Sequence: Synthetic polypeptide
GWGIPWCTLDPGGLQCAWLRGGGGSGGVVCQDWGVELCWQ

SEQ ID NO: 2103 - protein, 42 aa, synthetic construct
  REGION 1..42: note = Description of Artificial Sequence: Synthetic polypeptide
GWGIPWCTLDPGGLQCAWLGKHGGGGSGGVVCQWEGVELCWQ

SEQ ID NO: 2104 - protein, 41 aa, synthetic construct
  REGION 1..41: note = Description of Artificial Sequence: Synthetic polypeptide
GWGIPWCTLDPGGLQCAWLRMGGGGSGGVVCQDWGVELCWQ

SEQ ID NO: 2105 - protein, 40 aa, synthetic construct
  REGION 1..40: note = Description of Artificial Sequence: Synthetic polypeptide
IPWCTLDPGGLQCAWLRQMGGGGSGGVVCQDWEGVELCWQ

SEQ ID NO: 2106 - protein, 38 aa, synthetic construct; identical to SEQ ID NO: 2022
  REGION 1..38: note = Description of Artificial Sequence: Synthetic polypeptide

SEQ ID NO: 2107 - protein, 37 aa, synthetic construct; identical to SEQ ID NO: 2023
  REGION 1..37: note = Description of Artificial Sequence: Synthetic polypeptide

SEQ ID NO: 2108 - protein, 39 aa, synthetic construct
  REGION 1..39: note = Description of Artificial Sequence: Synthetic polypeptide
IPWCTLDPGGLQCAWLGKHGGGGSGGVVCQWEGVELCWQ

SEQ ID NO: 2109 - protein, 38 aa, synthetic construct
  REGION 1..38: note = Description of Artificial Sequence: Synthetic polypeptide
IPWCTLDPGGLQCAWLRMGGGGSGGVVCQDWGVELCWQ

SEQ ID NO: 2110 - protein, 61 aa, synthetic construct
  REGION 1..61: note = Description of Artificial Sequence: Synthetic polypeptide
  VARIANT 23..47: note = (G)n, (GS)n, (GGS)n, (GGGS)n or (GGGGS)n, or any combination thereof, wherein n is 1-5
  REGION 1..61: note = See specification as filed for detailed description of substitutions and preferred embodiments
VHRIPWCTLDPGGLQCAWLRQMXXXXXXXXXXXXXXXXXXXXXXXXXVVCQDWEGVELCWQ

SEQ ID NO: 2111 - protein, 59 aa, synthetic construct
  REGION 1..59: note = Description of Artificial Sequence: Synthetic polypeptide
  VARIANT 22..46: note = (G)n, (GS)n, (GGS)n, (GGGS)n or (GGGGS)n, or any combination thereof, wherein n is 1-5
  REGION 1..59: note = See specification as filed for detailed description of substitutions and preferred embodiments
VHRIPWCTLDPGGLQCAWLRQXXXXXXXXXXXXXXXXXXXXXXXXXVVCQDEGVELCWQ

SEQ ID NO: 2112 - protein, 58 aa, synthetic construct
  REGION 1..58: note = Description of Artificial Sequence: Synthetic polypeptide
  VARIANT 21..45: note = (G)n, (GS)n, (GGS)n, (GGGS)n or (GGGGS)n, or any combination thereof, wherein n is 1-5
  REGION 1..58: note = See specification as filed for detailed description of substitutions and preferred embodiments
VHRIPWCTLDPGGLQCAWLRXXXXXXXXXXXXXXXXXXXXXXXXXVVCQDWGVELCWQ

SEQ ID NO: 2113 - protein, 60 aa, synthetic construct
  REGION 1..60: note = Description of Artificial Sequence: Synthetic polypeptide
  VARIANT 23..47: note = (G)n, (GS)n, (GGS)n, (GGGS)n or (GGGGS)n, or any combination thereof, wherein n is 1-5
  REGION 1..60: note = See specification as filed for detailed description of substitutions and preferred embodiments
VHRIPWCTLDPGGLQCAWLGKHXXXXXXXXXXXXXXXXXXXXXXXXXVVCQWEGVELCWQ

SEQ ID NO: 2114 - protein, 59 aa, synthetic construct
  REGION 1..59: note = Description of Artificial Sequence: Synthetic polypeptide
  VARIANT 22..46: note = (G)n, (GS)n, (GGS)n, (GGGS)n or (GGGGS)n, or any combination thereof, wherein n is 1-5
  REGION 1..59: note = See specification as filed for detailed description of substitutions and preferred embodiments
VHRIPWCTLDPGGLQCAWLRMXXXXXXXXXXXXXXXXXXXXXXXXXVVCQDWGVELCWQ

SEQ ID NO: 2115 - protein, 61 aa, synthetic construct
  REGION 1..61: note = Description of Artificial Sequence: Synthetic polypeptide
  VARIANT 23..47: note = (G)n, (GS)n, (GGS)n, (GGGS)n or (GGGGS)n, or any combination thereof, wherein n is 1-5
  REGION 1..61: note = See specification as filed for detailed description of substitutions and preferred embodiments
GWGIPWCTLDPGGLQCAWLRQMXXXXXXXXXXXXXXXXXXXXXXXXXVVCQDWEGVELCWQ

SEQ ID NO: 2116 - protein, 59 aa, synthetic construct
  REGION 1..59: note = Description of Artificial Sequence: Synthetic polypeptide
  VARIANT 22..46: note = (G)n, (GS)n, (GGS)n, (GGGS)n or (GGGGS)n, or any combination thereof, wherein n is 1-5
  REGION 1..59: note = See specification as filed for detailed description of substitutions and preferred embodiments
GWGIPWCTLDPGGLQCAWLRQXXXXXXXXXXXXXXXXXXXXXXXXXVVCQDEGVELCWQ

SEQ ID NO: 2117 - protein, 58 aa, synthetic construct
  REGION 1..58: note = Description of Artificial Sequence: Synthetic polypeptide
  VARIANT 21..45: note = (G)n, (GS)n, (GGS)n, (GGGS)n or (GGGGS)n, or any combination thereof, wherein n is 1-5
  REGION 1..58: note = See specification as filed for detailed description of substitutions and preferred embodiments
GWGIPWCTLDPGGLQCAWLRXXXXXXXXXXXXXXXXXXXXXXXXXVVCQDWGVELCWQ

SEQ ID NO: 2118 - protein, 60 aa, synthetic construct
  REGION 1..60: note = Description of Artificial Sequence: Synthetic polypeptide
  VARIANT 23..47: note = (G)n, (GS)n, (GGS)n, (GGGS)n or (GGGGS)n, or any combination thereof, wherein n is 1-5
  REGION 1..60: note = See specification as filed for detailed description of substitutions and preferred embodiments
GWGIPWCTLDPGGLQCAWLGKHXXXXXXXXXXXXXXXXXXXXXXXXXVVCQWEGVELCWQ

SEQ ID NO: 2119 - protein, 59 aa, synthetic construct
  REGION 1..59: note = Description of Artificial Sequence: Synthetic polypeptide
  VARIANT 22..46: note = (G)n, (GS)n, (GGS)n, (GGGS)n or (GGGGS)n, or any combination thereof, wherein n is 1-5
  REGION 1..59: note = See specification as filed for detailed description of substitutions and preferred embodiments
GWGIPWCTLDPGGLQCAWLRMXXXXXXXXXXXXXXXXXXXXXXXXXVVCQDWGVELCWQ

SEQ ID NO: 2120 - protein, 58 aa, synthetic construct
  REGION 1..58: note = Description of Artificial Sequence: Synthetic polypeptide
  VARIANT 20..44: note = (G)n, (GS)n, (GGS)n, (GGGS)n or (GGGGS)n, or any combination thereof, wherein n is 1-5
  REGION 1..58: note = See specification as filed for detailed description of substitutions and preferred embodiments
IPWCTLDPGGLQCAWLRQMXXXXXXXXXXXXXXXXXXXXXXXXXVVCQDWEGVELCWQ

SEQ ID NO: 2121 - protein, 56 aa, synthetic construct
  REGION 1..56: note = Description of Artificial Sequence: Synthetic polypeptide
  VARIANT 19..43: note = (G)n, (GS)n, (GGS)n, (GGGS)n or (GGGGS)n, or any combination thereof, wherein n is 1-5
  REGION 1..56: note = See specification as filed for detailed description of substitutions and preferred embodiments
IPWCTLDPGGLQCAWLRQXXXXXXXXXXXXXXXXXXXXXXXXXVVCQDEGVELCWQ

SEQ ID NO: 2122 - protein, 55 aa, synthetic construct
  REGION 1..55: note = Description of Artificial Sequence: Synthetic polypeptide
  VARIANT 18..42: note = (G)n, (GS)n, (GGS)n, (GGGS)n or (GGGGS)n, or any combination thereof, wherein n is 1-5
  REGION 1..55: note = See specification as filed for detailed description of substitutions and preferred embodiments
IPWCTLDPGGLQCAWLRXXXXXXXXXXXXXXXXXXXXXXXXXVVCQDWGVELCWQ

SEQ ID NO: 2123 - protein, 57 aa, synthetic construct
  REGION 1..57: note = Description of Artificial Sequence: Synthetic polypeptide
  VARIANT 20..44: note = (G)n, (GS)n, (GGS)n, (GGGS)n or (GGGGS)n, or any combination thereof, wherein n is 1-5
  REGION 1..57: note = See specification as filed for detailed description of substitutions and preferred embodiments
IPWCTLDPGGLQCAWLGKHXXXXXXXXXXXXXXXXXXXXXXXXXVVCQWEGVELCWQ

SEQ ID NO: 2124 - protein, 56 aa, synthetic construct
  REGION 1..56: note = Description of Artificial Sequence: Synthetic polypeptide
  VARIANT 19..43: note = (G)n, (GS)n, (GGS)n, (GGGS)n or (GGGGS)n, or any combination thereof, wherein n is 1-5
  REGION 1..56: note = See specification as filed for detailed description of substitutions and preferred embodiments
IPWCTLDPGGLQCAWLRMXXXXXXXXXXXXXXXXXXXXXXXXXVVCQDWGVELCWQ

SEQ ID NO: 2125 - protein, 61 aa, synthetic construct
  REGION 1..61: note = Description of Artificial Sequence: Synthetic polypeptide
  VARIANT 1: note = A, G, P, S, T, or V
  VARIANT 2: note = F, H, W, or Y
  VARIANT 3: note = A, G, H, K, P, R, S, or T
  VARIANT 13: note = A, G, P, S, or T
  VARIANT 20: note = A, G, H, K, P, R, S, or T
  VARIANT 21: note = Any amino acid or absent
  VARIANT 22: note = Any amino acid or absent
  VARIANT 23..47: note = (G)n, (GS)n, (GGS)n, (GGGS)n or (GGGGS)n, or any combination thereof, wherein n is 1-5
  REGION 1..61: note = See specification as filed for detailed description of substitutions and preferred embodiments
XXXIPWCTLDPGXLQCAWLXXXXXXXXXXXXXXXXXXXXXXXXXXXXVVCQDWEGVELCWQ

SEQ ID NO: 2126 - protein, 60 aa, synthetic construct
  REGION 1..60: note = Description of Artificial Sequence: Synthetic polypeptide
  VARIANT 1: note = F, H, W, or Y
  VARIANT 2: note = A, G, H, K, P, R, S, or T
  VARIANT 12: note = A, G, P, S, or T
  VARIANT 19: note = A, G, H, K, P, R, S, or T
  VARIANT 20: note = Any amino acid or absent
  VARIANT 21: note = Any amino acid or absent
  VARIANT 22..46: note = (G)n, (GS)n, (GGS)n, (GGGS)n or (GGGGS)n, or any combination thereof, wherein n is 1-5
  REGION 1..60: note = See specification as filed for detailed description of substitutions and preferred embodiments
XXIPWCTLDPGXLQCAWLXXXXXXXXXXXXXXXXXXXXXXXXXXXXVVCQDWEGVELCWQ

SEQ ID NO: 2127 - protein, 59 aa, synthetic construct
  REGION 1..59: note = Description of Artificial Sequence: Synthetic polypeptide
  VARIANT 1: note = A, G, H, K, P, R, S, or T
  VARIANT 11: note = A, G, P, S, or T
  VARIANT 18: note = A, G, H, K, P, R, S, or T
  VARIANT 19: note = Any amino acid or absent
  VARIANT 20: note = Any amino acid or absent
  VARIANT 21..45: note = (G)n, (GS)n, (GGS)n, (GGGS)n or (GGGGS)n, or any combination thereof, wherein n is 1-5
  REGION 1..59: note = See specification as filed for detailed description of substitutions and preferred embodiments
XIPWCTLDPGXLQCAWLXXXXXXXXXXXXXXXXXXXXXXXXXXXXVVCQDWEGVELCWQ

SEQ ID NO: 2128 - protein, 58 aa, synthetic construct
  REGION 1..58: note = Description of Artificial Sequence: Synthetic polypeptide
  VARIANT 10: note = A, G, P, S, or T
  VARIANT 17: note = A, G, H, K, P, R, S, or T
  VARIANT 18: note = Any amino acid or absent
  VARIANT 19: note = Any amino acid or absent
  VARIANT 20..44: note = (G)n, (GS)n, (GGS)n, (GGGS)n or (GGGGS)n, or any combination thereof, wherein n is 1-5
  REGION 1..58: note = See specification as filed for detailed description of substitutions and preferred embodiments
IPWCTLDPGXLQCAWLXXXXXXXXXXXXXXXXXXXXXXXXXXXXVVCQDWEGVELCWQ

SEQ ID NO: 2129 - protein, 60 aa, synthetic construct
  REGION 1..60: note = Description of Artificial Sequence: Synthetic polypeptide
  VARIANT 1: note = A, G, P, S, T, or V
  VARIANT 2: note = F, H, W, or Y
  VARIANT 3: note = A, G, H, K, P, R, S, or T
  VARIANT 13: note = A, G, P, S, or T
  VARIANT 20: note = A, G, H, K, P, R, S, or T
  VARIANT 21: note = Any amino acid or absent
  VARIANT 22..46: note = (G)n, (GS)n, (GGS)n, (GGGS)n or (GGGGS)n, or any combination thereof, wherein n is 1-5
  REGION 1..60: note = See specification as filed for detailed description of substitutions and preferred embodiments
XXXIPWCTLDPGXLQCAWLXXXXXXXXXXXXXXXXXXXXXXXXXXXVVCQDWEGVELCWQ

SEQ ID NO: 2130 - protein, 59 aa, synthetic construct
  REGION 1..59: note = Description of Artificial Sequence: Synthetic polypeptide
  VARIANT 1: note = A, G, P, S, T, or V
  VARIANT 2: note = F, H, W, or Y
  VARIANT 3: note = A, G, H, K, P, R, S, or T
  VARIANT 13: note = A, G, P, S, or T
  VARIANT 20: note = A, G, H, K, P, R, S, or T
  VARIANT 21..45: note = (G)n, (GS)n, (GGS)n, (GGGS)n or (GGGGS)n, or any combination thereof, wherein n is 1-5
  REGION 1..59: note = See specification as filed for detailed description of substitutions and preferred embodiments
XXXIPWCTLDPGXLQCAWLXXXXXXXXXXXXXXXXXXXXXXXXXXVVCQDWEGVELCWQ

SEQ ID NO: 2131 - protein, 58 aa, synthetic construct
  REGION 1..58: note = Description of Artificial Sequence: Synthetic polypeptide
  VARIANT 1: note = A, G, P, S, T, or V
  VARIANT 2: note = F, H, W, or Y
  VARIANT 3: note = A, G, H, K, P, R, S, or T
  VARIANT 13: note = A, G, P, S, or T
  VARIANT 20..44: note = (G)n, (GS)n, (GGS)n, (GGGS)n or (GGGGS)n, or any combination thereof, wherein n is 1-5
  REGION 1..58: note = See specification as filed for detailed description of substitutions and preferred embodiments
XXXIPWCTLDPGXLQCAWLXXXXXXXXXXXXXXXXXXXXXXXXXVVCQDWEGVELCWQ

SEQ ID NO: 2132 - protein, 57 aa, synthetic construct
  REGION 1..57: note = Description of Artificial Sequence: Synthetic polypeptide
  VARIANT 1: note = A, G, P, S, T, or V
  VARIANT 2: note = F, H, W, or Y
  VARIANT 3: note = A, G, H, K, P, R, S, or T
  VARIANT 12: note = A, G, P, S, or T
  VARIANT 19..43: note = (G)n, (GS)n, (GGS)n, (GGGS)n or (GGGGS)n, or any combination thereof, wherein n is 1-5
  REGION 1..57: note = See specification as filed for detailed description of substitutions and preferred embodiments
XXXIPWCTLDPXLQCAWLXXXXXXXXXXXXXXXXXXXXXXXXXVVCQDWEGVELCWQ

SEQ ID NO: 2133-2480 - skipped (348 entries)

SEQ ID NO: 2481 - protein, 12 aa, synthetic construct
  REGION 1..12: note = Description of Artificial Sequence: Synthetic peptide
DLSDLSTFWLSQ

SEQ ID NO: 2482-9322 - skipped (6841 entries)

SEQ ID NO: 9323 - protein, 20 aa, synthetic construct
  REGION 1..20: note = Description of Artificial Sequence: Synthetic peptide
  SITE 1..20: note = This sequence may encompass 1-10 "Pro Ala" repeating units
PAPAPAPAPAPAPAPAPAPA

SEQ ID NO: 9324 - protein, 25 aa, synthetic construct
  REGION 1..25: note = Description of Artificial Sequence: Synthetic peptide
  SITE 1..25: note = This sequence may encompass 1-5 "Gly Gly Gly Gly Ser" repeating units
GGGGSGGGGSGGGGSGGGGSGGGGS

SEQ ID NO: 9325-9378 - skipped (54 entries)

SEQ ID NO: 9379 - protein, 40 aa, synthetic construct
  REGION 1..40: note = Description of Artificial Sequence: Synthetic polypeptide
  SITE 1..40: note = This sequence may encompass 1-20 "Gly Gly" repeating units
GGGGGGGGGGGGGGGGGGGGGGGGGGGGGGGGGGGGGGGG

SEQ ID NO: 9380 - protein, 20 aa, synthetic construct
  REGION 1..20: note = Description of Artificial Sequence: Synthetic peptide
  SITE 1..20: note = This sequence may encompass 1-20 residues
GGGGGGGGGGGGGGGGGGGG

SEQ ID NO: 9381 - protein, 40 aa, synthetic construct
  REGION 1..40: note = Description of Artificial Sequence: Synthetic polypeptide
  SITE 1..40: note = This sequence may encompass 1-20 "Gly Ser" repeating units
GSGSGSGSGSGSGSGSGSGSGSGSGSGSGSGSGSGSGSGS

SEQ ID NO: 9382 - protein, 60 aa, synthetic construct
  REGION 1..60: note = Description of Artificial Sequence: Synthetic polypeptide
  SITE 1..60: note = This sequence may encompass 1-20 "Gly Gly Ser" repeating units
GGSGGSGGSGGSGGSGGSGGSGGSGGSGGSGGSGGSGGSGGSGGSGGSGGSGGSGGSGGS

SEQ ID NO: 9383 - protein, 80 aa, synthetic construct
  REGION 1..80: note = Description of Artificial Sequence: Synthetic polypeptide
  SITE 1..80: note = This sequence may encompass 1-20 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 9384 - protein, 100 aa, synthetic construct
  REGION 1..100: note = Description of Artificial Sequence: Synthetic polypeptide
  SITE 1..100: note = This sequence may encompass 1-20 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 9385 - protein, 10 aa, synthetic construct
  REGION 1..10: note = Description of Artificial Sequence: Synthetic peptide
  SITE 1..10: note = This sequence may encompass 1-10 residues
GGGGGGGGGG

SEQ ID NO: 9386 - protein, 20 aa, synthetic construct
  REGION 1..20: note = Description of Artificial Sequence: Synthetic peptide
  SITE 1..20: note = This sequence may encompass 1-10 "Gly Ser" repeating units
GSGSGSGSGSGSGSGSGSGS

SEQ ID NO: 9387 - protein, 30 aa, synthetic construct
  REGION 1..30: note = Description of Artificial Sequence: Synthetic polypeptide
  SITE 1..30: note = This sequence may encompass 1-10 "Gly Gly Ser" repeating units
GGSGGSGGSGGSGGSGGSGGSGGSGGSGGS

SEQ ID NO: 9388 - protein, 40 aa, synthetic construct
  REGION 1..40: note = Description of Artificial Sequence: Synthetic polypeptide
  SITE 1..40: note = This sequence may encompass 1-10 "Gly Gly Gly Ser" repeating units
GGGSGGGSGGGSGGGSGGGSGGGSGGGSGGGSGGGSGGGS

SEQ ID NO: 9389 - protein, 50 aa, synthetic construct
  REGION 1..50: note = Description of Artificial Sequence: Synthetic polypeptide
  SITE 1..50: note = This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 9390 - protein, 5 aa, synthetic construct
  REGION 1..5: note = Description of Artificial Sequence: Synthetic peptide
  SITE 1..5: note = This sequence may encompass 1-5 residues
GGGGG

SEQ ID NO: 9391 - protein, 10 aa, synthetic construct
  REGION 1..10: note = Description of Artificial Sequence: Synthetic peptide
  SITE 1..10: note = This sequence may encompass 1-5 "Gly Ser" repeating units
GSGSGSGSGS

SEQ ID NO: 9392 - protein, 15 aa, synthetic construct
  REGION 1..15: note = Description of Artificial Sequence: Synthetic peptide
  SITE 1..15: note = This sequence may encompass 1-5 "Gly Gly Ser" repeating units
GGSGGSGGSGGSGGS

SEQ ID NO: 9393 - protein, 20 aa, synthetic construct
  REGION 1..20: note = Description of Artificial Sequence: Synthetic peptide
  SITE 1..20: note = This sequence may encompass 1-5 "Gly Gly Gly Ser" repeating units
GGGSGGGSGGGSGGGSGGGS

SEQ ID NO: 9394 - protein, 25 aa, synthetic construct
  REGION 1..25: note = Description of Artificial Sequence: Synthetic peptide
  SITE 1..25: note = This sequence may encompass 1-5 "Gly Gly Gly Gly Ser" repeating units
GGGGSGGGGSGGGGSGGGGSGGGGS

SEQ ID NO: 9395 - protein, 5 aa, synthetic construct
  REGION 1..5: note = Description of Artificial Sequence: Synthetic peptide
GGGGS

SEQ ID NO: 9396 - protein, 10 aa, synthetic construct
  REGION 1..10: note = Description of Artificial Sequence: Synthetic peptide
GGGGSGGGGS

SEQ ID NO: 9397 - protein, 15 aa, synthetic construct
  REGION 1..15: note = Description of Artificial Sequence: Synthetic peptide
GGGGSGGGGSGGGGS

SEQ ID NO: 9398 - protein, 20 aa, synthetic construct
  REGION 1..20: note = Description of Artificial Sequence: Synthetic peptide
GGGGSGGGGSGGGGSGGGGS

SEQ ID NO: 9399-9400 - skipped (2 entries)

SEQ ID NO: 9401 - protein, 4 aa, synthetic construct
  REGION 1..4: note = Description of Artificial Sequence: Synthetic peptide
GGGG

SEQ ID NO: 9402 - skipped

SEQ ID NO: 9403 - protein, 4 aa, synthetic construct
  REGION 1..4: note = Description of Artificial Sequence: Synthetic peptide
GGGS

SEQ ID NO: 9404 - protein, 7 aa, synthetic construct
  REGION 1..7: note = Description of Artificial Sequence: Synthetic peptide
GGGGSGG

SEQ ID NO: 9405 - protein, 6 aa, synthetic construct
  REGION 1..6: note = Description of Artificial Sequence: Synthetic peptide
GGSGGS

SEQ ID NO: 9406 - protein, 5 aa, synthetic construct
  REGION 1..5: note = Description of Artificial Sequence: Synthetic peptide
GGGGG

SEQ ID NO: 9407 - protein, 20 aa, synthetic construct
  REGION 1..20: note = Description of Artificial Sequence: Synthetic peptide
GSGSGSGSGSGSGSGSGSGS

SEQ ID NO: 9408-9419 - skipped (12 entries)

SEQ ID NO: 9420 - protein, 20 aa, synthetic construct
  REGION 1..20: note = Description of Artificial Sequence: Synthetic peptide
  SITE 1..20: note = This sequence may encompass 1-20 residues
PPPPPPPPPPPPPPPPPPPP

SEQ ID NO: 9421 - protein, 40 aa, synthetic construct
  REGION 1..40: note = Description of Artificial Sequence: Synthetic polypeptide
  SITE 1..40: note = This sequence may encompass 1-20 "Pro Ala" repeating units
PAPAPAPAPAPAPAPAPAPAPAPAPAPAPAPAPAPAPAPA

SEQ ID NO: 9422 - protein, 10 aa, synthetic construct
  REGION 1..10: note = Description of Artificial Sequence: Synthetic peptide
  SITE 1..10: note = This sequence may encompass 1-10 residues
PPPPPPPPPP

SEQ ID NO: 9423 - protein, 20 aa, synthetic construct
  REGION 1..20: note = Description of Artificial Sequence: Synthetic peptide
  SITE 1..20: note = This sequence may encompass 1-10 "Pro Ala" repeating units
PAPAPAPAPAPAPAPAPAPA

SEQ ID NO: 9424 - protein, 5 aa, synthetic construct
  REGION 1..5: note = Description of Artificial Sequence: Synthetic peptide
  SITE 1..5: note = This sequence may encompass 1-5 residues
PPPPP

SEQ ID NO: 9425 - protein, 10 aa, synthetic construct
  REGION 1..10: note = Description of Artificial Sequence: Synthetic peptide
  SITE 1..10: note = This sequence may encompass 1-5 "Pro Ala" repeating units
PAPAPAPAPA

SEQ ID NO: 9426 - protein, 10 aa, synthetic construct
  REGION 1..10: note = Description of Artificial Sequence: Synthetic peptide
PAPAPAPAPA

SEQ ID NO: 9427 - protein, 14 aa, synthetic construct
  REGION 1..14: note = Description of Artificial Sequence: Synthetic peptide
PAPAPAPAPAPAPA

SEQ ID NO: 9428 - protein, 20 aa, synthetic construct
  REGION 1..20: note = Description of Artificial Sequence: Synthetic peptide
PAPAPAPAPAPAPAPAPAPA

SEQ ID NO: 9429 - protein, 40 aa, synthetic construct
  REGION 1..40: note = Description of Artificial Sequence: Synthetic polypeptide
  VARIANT 2: note = Ala, Lys, or Glu
  VARIANT 4: note = Ala, Lys, or Glu
  VARIANT 6: note = Ala, Lys, or Glu
  VARIANT 8: note = Ala, Lys, or Glu
  VARIANT 10: note = Ala, Lys, or Glu
  VARIANT 12: note = Ala, Lys, or Glu
  VARIANT 14: note = Ala, Lys, or Glu
  VARIANT 16: note = Ala, Lys, or Glu
  VARIANT 18: note = Ala, Lys, or Glu
  VARIANT 20: note = Ala, Lys, or Glu
  VARIANT 22: note = Ala, Lys, or Glu
  VARIANT 24: note = Ala, Lys, or Glu
  VARIANT 26: note = Ala, Lys, or Glu
  VARIANT 28: note = Ala, Lys, or Glu
  VARIANT 30: note = Ala, Lys, or Glu
  VARIANT 32: note = Ala, Lys, or Glu
  VARIANT 34: note = Ala, Lys, or Glu
  VARIANT 36: note = Ala, Lys, or Glu
  VARIANT 38: note = Ala, Lys, or Glu
  VARIANT 40: note = Ala, Lys, or Glu
  SITE 1..40: note = This sequence may encompass 1-20 "Pro Xaa" repeating units; wherein Xaa is Ala, Lys or Glu
PXPXPXPXPXPXPXPXPXPXPXPXPXPXPXPXPXPXPXPX

SEQ ID NO: 9430 - protein, 46 aa, synthetic construct
  REGION 1..46: note = Description of Artificial Sequence: Synthetic polypeptide
VHRIPWCTLDPGGLQCAWLGKHGGGGSGGVVCQDWEGVELCWQPPA

SEQ ID NO: 9431 - protein, 4 aa, synthetic construct
  REGION 1..4: note = Description of Artificial Sequence: Synthetic peptide
QMGG

SEQ ID NO: 9432 - protein, 5 aa, synthetic construct
  REGION 1..5: note = Description of Artificial Sequence: Synthetic peptide
RQMGG

SEQ ID NO: 9433 - protein, 4 aa, synthetic construct
  REGION 1..4: note = Description of Artificial Sequence: Synthetic peptide
VHRI

SEQ ID NO: 9434-9437 - skipped (4 entries)

SEQ ID NO: 9438 - protein, 20 aa, synthetic construct
  REGION 1..20: note = Description of Artificial Sequence: Synthetic peptide
  VARIANT 1: note = Any amino acid comprising a basic side chain
  VARIANT 2: note = Any amino acid comprising a hydroxyl-containing side chain
  VARIANT 3: note = Any amino acid comprising an acidic side chain or a large hydrophobic side chain
  VARIANT 4: note = Any amino acid comprising a large hydrophobic side chain
  VARIANT 5: note = Any amino acid comprising an acidic side chain or a large hydrophobic side chain
  VARIANT 7: note = Any amino acid comprising an acidic side chain or a polar/neutral side chain
  VARIANT 8: note = Any amino acid comprising an acidic side chain
  VARIANT 9: note = Any amino acid comprising a large hydrophobic side chain or an aromatic side chain
  VARIANT 10: note = Any amino acid comprising an acidic side chain or a polar/neutral side chain
  VARIANT 17: note = Any amino acid comprising a large hydrophobic side chain
  VARIANT 19: note = Any amino acid
  VARIANT 20: note = Any amino acid comprising an acidic side chain
XXXXXCXXXXGVELCWXEXX

SEQ ID NO: 9439 - protein, 18 aa, synthetic construct
  REGION 1..18: note = Description of Artificial Sequence: Synthetic peptide
  VARIANT 1: note = Any amino acid comprising a hydroxyl-containing side chain
  VARIANT 2: note = Any amino acid comprising an acidic side chain or a large hydrophobic side chain
  VARIANT 3: note = Any amino acid comprising a large hydrophobic side chain
  VARIANT 4: note = Any amino acid comprising an acidic side chain or a large hydrophobic side chain
  VARIANT 6: note = Any amino acid comprising an acidic side chain or a polar/neutral side chain
  VARIANT 7: note = Any amino acid comprising an acidic side chain
  VARIANT 8: note = Any amino acid comprising a large hydrophobic side chain or an aromatic side chain
  VARIANT 9: note = Any amino acid comprising an acidic side chain or a polar/neutral side chain
  VARIANT 16: note = Any amino acid comprising a large hydrophobic side chain
  VARIANT 18: note = Any amino acid
XXXXCXXXXGVELCWXEX

SEQ ID NO: 9440 - protein, 16 aa, synthetic construct
  REGION 1..16: note = Description of Artificial Sequence: Synthetic peptide
  VARIANT 1: note = Any amino acid comprising an acidic side chain or a large hydrophobic side chain
  VARIANT 2: note = Any amino acid comprising a large hydrophobic side chain
  VARIANT 3: note = Any amino acid comprising an acidic side chain or a large hydrophobic side chain
  VARIANT 5: note = Any amino acid comprising an acidic side chain or a polar/neutral side chain
  VARIANT 6: note = Any amino acid comprising an acidic side chain
  VARIANT 7: note = Any amino acid comprising a large hydrophobic side chain or an aromatic side chain
  VARIANT 8: note = Any amino acid comprising an acidic side chain or a polar/neutral side chain
  VARIANT 15: note = Any amino acid comprising a large hydrophobic side chain
XXXCXXXXGVELCWXE

SEQ ID NO: 9441 - protein, 14 aa, synthetic construct
  REGION 1..14: note = Description of Artificial Sequence: Synthetic peptide
  VARIANT 1: note = Any amino acid comprising a large hydrophobic side chain
  VARIANT 2: note = Any amino acid comprising an acidic side chain or a large hydrophobic side chain
  VARIANT 4: note = Any amino acid comprising an acidic side chain or a polar/neutral side chain
  VARIANT 5: note = Any amino acid comprising an acidic side chain
  VARIANT 6: note = Any amino acid comprising a large hydrophobic side chain or an aromatic side chain
  VARIANT 7: note = Any amino acid comprising an acidic side chain or a polar/neutral side chain
  VARIANT 14: note = Any amino acid comprising a large hydrophobic side chain
XXCXXXXGVELCWX

SEQ ID NO: 9442 - protein, 12 aa, synthetic construct
  REGION 1..12: note = Description of Artificial Sequence: Synthetic peptide
  VARIANT 1: note = Any amino acid comprising an acidic side chain or a large hydrophobic side chain
  VARIANT 3: note = Any amino acid comprising an acidic side chain or a polar/neutral side chain
  VARIANT 4: note = Any amino acid comprising an acidic side chain
  VARIANT 5: note = Any amino acid comprising a large hydrophobic side chain or an aromatic side chain
  VARIANT 6: note = Any amino acid comprising an acidic side chain or a polar/neutral side chain
XCXXXXGVELCW

SEQ ID NO: 9443 - protein, 10 aa, synthetic construct
  REGION 1..10: note = Description of Artificial Sequence: Synthetic peptide
  VARIANT 2: note = Any amino acid comprising an acidic side chain or a polar/neutral side chain
  VARIANT 3: note = Any amino acid comprising an acidic side chain
  VARIANT 4: note = Any amino acid comprising a large hydrophobic side chain or an aromatic side chain
  VARIANT 5: note = Any amino acid comprising an acidic side chain or a polar/neutral side chain
CXXXXGVELC

What is claimed is:

1. An IL-7Rαγc ligand, wherein the IL-7Rαγc ligand comprises an amino acid sequence of Formula (6) (SEQ ID NO: 2125), an amino acid sequence of Formula (6a) (SEQ ID NO: 2126), an amino acid sequence of Formula (6b) (SEQ ID NO: 2127), an amino acid sequence of Formula (6c) (SEQ ID NO: 2128), an amino acid sequence of Formula (6d) (SEQ ID NO: 2129), an amino acid sequence of Formula (6e) (SEQ ID NO: 2130), an amino acid sequence of Formula (6f) (SEQ ID NO: 2131), or an amino acid sequence of Formula (6g) (SEQ ID NO: 2132):

(6)
-$X^{198}$-$X^{199}$-$X^{200}$-I-P-W-C-T-L-D-P-G-$X^{210}$-L-Q-C-A-W-L-$X^{217}$-$X^{218}$-$X^{219}$-$X^{400}$-VVCQDWEGVELCWQ- (6a)
-$X^{199}$-$X^{200}$-I-P-W-C-T-L-D-P-G-$X^{210}$-L-Q-C-A-W-L-$X^{217}$-$X^{218}$-$X^{219}$-$X^{400}$-VVCQDWEGVELCWQ- (6b)
-$X^{200}$-I-P-W-C-T-L-D-P-G-$X^{210}$-L-Q-C-A-W-L-$X^{217}$-$X^{218}$-$X^{219}$-$X^{400}$-VVCQDWEGVELCWQ- (6c)
-I-P-W-C-T-L-D-P-G-$X^{210}$-L-Q-C-A-W-L-$X^{217}$-$X^{218}$-$X^{219}$-$X^{400}$-VVCQDWEGVELCWQ- (6d)
-$X^{198}$-$X^{199}$-$X^{200}$-I-P-W-C-T-L-D-P-G-$X^{210}$-L-Q-C-A-W-L-$X^{217}$-$X^{218}$-$X^{400}$-VVCQDWEGVELCWQ- (6e)
-$X^{198}$-$X^{199}$-$X^{200}$-I-P-W-C-T-L-D-P-G-$X^{210}$-L-Q-C-A-W-L-$X^{217}$-$X^{400}$-VVCQDWEGVELCWQ- (6f)
-$X^{198}$-$X^{199}$-$X^{200}$-I-P-W-C-T-L-D-P-G-$X^{210}$-L-Q-C-A-W-L-$X^{400}$-VVCQDWEGVELCWQ- (6g)
-$X^{198}$-$X^{199}$-$X^{200}$-I-P-W-C-T-L-D-P-G-$X^{210}$-L-Q-C-A-W-L-$X^{400}$-VVCQDWEGVELCWQwherein,
  $X^{198}$ is selected from A, G, P, S, T, and V;
  $X^{199}$ is selected from F, H, W, and Y;
  $X^{200}$ is selected from A, G, H, K, P, R, S, and T;
  $X^{210}$ is selected form A, G, P, S, and T;
  $X^{217}$ is selected from A, G, H, K, P, R, S, and T;
  $X^{218}$ is selected from an amino acid and a single bond;
  $X^{219}$ is selected from an amino acid and a single bond; and
  $X^{400}$ is selected from (G)n (SEQ ID NO: 9390), (GS)n (SEQ ID NO: 9391), (GGS)n (SEQ ID NO: 9392), (GGGS)n (SEQ ID NO: 9393), (GGGGS)n (SEQ ID NO: 9394), and a combination of any of the foregoing, wherein n is an integer from 1 to 5.

2. The IL-7Rαγc ligand of claim 1, wherein the IL-7Rαγc ligand comprises any one of SEQ ID NO: 2110-2124:

SEQ ID NO: 2110
VHRIPWCTLDPGGLQCAWLRQM-$X^{400}$-VVCQDWEGVELCWQ

SEQ ID NO: 2111
VHRIPWCTLDPGGLQCAWLRQ-$X^{400}$-VVCQDEGVELCWQ

SEQ ID NO: 2112
VHRIPWCTLDPGGLQCAWLR-$X^{400}$-VVCQDWGVELCWQ

SEQ ID NO: 2113
VHRIPWCTLDPGGLQCAWLGKH-$X^{400}$-VVCQWEGVELCWQ

SEQ ID NO: 2114
VHRIPWCTLDPGGLQCAWLRM-$X^{400}$-VVCQDWGVELCWQ

SEQ ID NO: 2115
GWGIPWCTLDPGGLQCAWLRQM-$X^{400}$-VVCQDWEGVELCWQ

SEQ ID NO: 2116
GWGIPWCTLDPGGLQCAWLRQ-$X^{400}$-VVCQDEGVELCWQ

SEQ ID NO: 2117
GWGIPWCTLDPGGLQCAWLR-$X^{400}$-VVCQDWGVELCWQ

SEQ ID NO: 2118
GWGIPWCTLDPGGLQCAWLGKH-$X^{400}$-VVCQWEGVELCWQ

SEQ ID NO: 2119
GWGIPWCTLDPGGLQCAWLRM-$X^{400}$-VVCQDWGVELCWQ

SEQ ID NO: 2120
IPWCTLDPGGLQCAWLRQM-$X^{400}$-VVCQDWEGVELCWQ

SEQ ID NO: 2121
IPWCTLDPGGLQCAWLRQ-$X^{400}$-VVCQDEGVELCWQ

SEQ ID NO: 2122
IPWCTLDPGGLQCAWLR-$X^{400}$-VVCQDWGVELCWQ

SEQ ID NO: 2123
IPWCTLDPGGLQCAWLGKH-$X^{400}$-VVCQWEGVELCWQ

SEQ ID NO: 2124
IPWCTLDPGGLQCAWLRM-$X^{400}$-VVCQDWGVELCWQ wherein $X^{400}$ is selected from (G)n (SEQ ID NO: 9390), (GS)n (SEQ ID NO: 9391), (GGS)n (SEQ ID NO: 9392), (GGGS)n (SEQ ID NO: 9393), (GGGGS)n (SEQ ID NO: 9394), and a combination of any of the foregoing, wherein n is an integer from 1 to 5.

3. The IL-7Rαγc ligand of claim 2, wherein $X^{400}$ is selected from -GGGGSGG-, -GG-GGGGS-GG-, and -G-GGGGS-GG-.

4. The IL-7Rαγc ligand of claim 2, wherein $X^{400}$ is -GGGGSGG-.

5. The IL-7Rαγc ligand of claim 1, wherein the IL-7Rαγc ligand comprises any one of SEQ ID NO: 2091, 2096-2109, and 2064-2073:

SEQ ID NO: 2091
VHRIPWCTLDPGGLQCAWLRQMGGGGSGGVVCQDWEGVELCWQ

SEQ ID NO: 2096
VHRIPWCTLDPGGLQCAWLRQGGGGSGGVVCQDEGVELCWQ

SEQ ID NO: 2097
VHRIPWCTLDPGGLQCAWLRGGGGSGGVVCQDWGVELCWQ

SEQ ID NO: 2098
VHRIPWCTLDPGGLQCAWLGKHGGGGSGGVVCQWEGVELCWQ

SEQ ID NO: 2099
VHRIPWCTLDPGGLQCAWLRMGGGGSGGVVCQDWGVELCWQ

SEQ ID NO: 2100
GWGIPWCTLDPGGLQCAWLRQMGGGGSGGVVCQDWEGVELCWQ

SEQ ID NO: 2101
GWGIPWCTLDPGGLQCAWLRQGGGGSGGVVCQDEGVELCWQ

SEQ ID NO: 2102
GWGIPWCTLDPGGLQCAWLRGGGGSGGVVCQDWGVELCWQ

```
                                                  SEQ ID NO: 2103
GWGIPWCTLDPGGLQCAWLGKHGGGGSGGVVCQWEGVELCWQ

SEQ ID NO: 2104
GWGIPWCTLDPGGLQCAWLRMGGGGSGGVVCQDWGVELCWQ

SEQ ID NO: 2105
IPWCTLDPGGLQCAWLRQMGGGGSGGVVCQDWEGVELCWQ

SEQ ID NO: 2106
IPWCTLDPGGLQCAWLRQGGGGSGGVVCQDEGVELCWQ

SEQ ID NO: 2107
IPWCTLDPGGLQCAWLRGGGGSGGVVCQDWGVELCWQ

SEQ ID NO: 2108
IPWCTLDPGGLQCAWLGKHGGGGSGGVVCQWEGVELCWQ

SEQ ID NO: 2109
IPWCTLDPGGLQCAWLRMGGGGSGGVVCQDWGVELCWQ

SEQ ID NO: 2064
VHRIPWCTLDPGGLQCAWLRQMGGGGSGGVVCQDWEGVELCWQPPA

SEQ ID NO: 2065
VHRIPWCTLDPGGLQCAWLRQGGGGSGGVVCQDWEGVELCWQPPA

SEQ ID NO: 2066
VHRIPWCTLDPGGLQCAWLRGGGGSGGVVCQDWEGVELCWQPPA

SEQ ID NO: 2067
VHRIPWCTLDPGGLQCAWLGKHGGGGSGGVVCQDWEGVELCWQPPA

SEQ ID NO: 2068
VHRIPWCTLDPGGLQCAWLRQGGGGGSGGVVCQDWEGVELCWQPPA

SEQ ID NO: 2069
VHRIPWCTLDPGGLQCAWLRGGGGGSGGVVCQDWEGVELCWQPPA

SEQ ID NO: 2070
VHRIPWCTLDPGGLQCAWLRQGGGGSGGVVCQDWEGVELCWQGG

SEQ ID NO: 2071
VHRIPWCTLDPGGLQCAWLRGGGGSGGVVCQDWEGVELCWQGG

SEQ ID NO: 2072
GWGIPWCTLDPGSLQCAWLGKHGGGGSGGVVCQDWEGVELCWQGG

SEQ ID NO: 2073
VHRIPWCTLDPGGLQCAWLRQM(PA)8GVVCQDWEGVELCWQGG.
```

6. The IL-7Rαγc ligand of claim 1, wherein the IL-7Rαγc ligand comprises (G)n bonded to the N-terminus, the C-terminus, or both the N-terminus and the C-terminus, wherein n is independently selected from 1 to 5.

7. The IL-7Rαγc ligand of claim 1, wherein the IL-7Rαγc ligand comprises SEQ ID NO: 2072.

8. A compound comprising the IL-7Rαγc ligand of claim 1.

9. The compound of claim 8, wherein the compound comprises the IL-7Rαγc ligand bound to a construct partner through a construct linker.

10. The compound of claim 9, wherein the construct linker comprises (G)n (SEQ ID NO: 9380), (GS)n (SEQ ID NO: 9381), (GGS)n (SEQ ID NO: 9382), (GGGS)n (SEQ ID NO: 9383), (GGGGS)n (SEQ ID NO: 9384), or a combination of any of the foregoing, wherein n is an integer from 1 to 20.

11. The compound of claim 9, wherein the construct linker comprises $(P)_n$ (SEQ ID NO: 9420), $(PA)_n$ (SEQ ID NO: 9421), or a combination thereof, wherein n is an integer from 1 to 20.

12. The compound of claim 9, wherein the construct partner comprises a protein.

13. The compound of claim 9, wherein the compound comprises a tumor targeting moiety.

14. The compound of claim 13, wherein the tumor targeting moiety comprises tumor-specific antibody, a tumor-specific antibody fragment, a tumor-specific protein, a tumor-specific peptide, a non-peptidyl tumor cell ligand, or a combination of any of the foregoing.

15. The compound of claim 9, wherein the construct partner comprises a polymer, a polypeptide, an Fc-fragment, an immunoglobulin fragment, and an antibody, a vaccine, a viral surface antigen, or a virus like particle.

16. The compound of claim 9, wherein the construct partner comprises an Fc fragment.

17. The compound of claim 16, wherein the Fc fragment comprises an IgG1 immunoglobulin Fc fragment, an IgG2 immunoglobulin Fc fragment, or an IgG4 immunoglobulin Fc fragment.

18. The compound of claim 9, wherein the construct partner comprises an IgG Fc-fragment, wherein the IL-7Rαγc ligand is bound to one or both CH3 domains of the IgG Fc-fragment.

19. The compound of claim 18, wherein the N-terminus of the IL-7Rαγc ligand is bound to the C-terminus of the CH3 domain of the IgG Fc-fragment through the construct linker.

20. The compound of claim 18, wherein the IL-7Rαγc ligand comprises SEQ ID NO: 2072.

21. The compound of claim 18, wherein the construct linker comprises (GS)n (SEQ ID NO: 9381) and n is an integer from 1 to 20.

22. The compound of claim 18, wherein the construct linker comprises (GS)10.

23. A pharmaceutical composition comprising the IL-7Rαγc ligand claim 1.

24. The pharmaceutical composition of claim 23, further comprising a chemotherapeutic agent, an immunomodulator, a checkpoint inhibitor, a vaccine, or a combination of any of the foregoing.

25. A pharmaceutical composition comprising the compound of claim 8.

26. The pharmaceutical composition of claim 25, further comprising a chemotherapeutic agent, an immunomodulator, a checkpoint inhibitor, a vaccine, or a combination of any of the foregoing.

27. A nucleic acid encoding for the IL-7Rαγc ligand of claim 1.

28. A nucleic acid encoding for the compound of claim 8.

* * * * *